United States Patent
Abad

(10) Patent No.: US 9,670,500 B2
(45) Date of Patent: Jun. 6, 2017

(54) TRANSGENIC PLANTS WITH ENHANCED TRAITS

(71) Applicant: Monsanto Technology LLC, St. Louis, MO (US)

(72) Inventor: Mark Scott Abad, Webster Groves, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 14/395,636

(22) PCT Filed: Mar. 6, 2013

(86) PCT No.: PCT/US2013/029229
§ 371 (c)(1),
(2) Date: Oct. 20, 2014

(87) PCT Pub. No.: WO2013/158227
PCT Pub. Date: Oct. 24, 2013

(65) Prior Publication Data
US 2015/0089683 A1    Mar. 26, 2015

Related U.S. Application Data

(60) Provisional application No. 61/687,209, filed on Apr. 20, 2012.

(51) Int. Cl.
| | | |
|---|---|---|
| *C12N 15/82* | (2006.01) | |
| *C07K 14/415* | (2006.01) | |
| *C07K 14/81* | (2006.01) | |
| *C12N 9/04* | (2006.01) | |
| *A01H 1/02* | (2006.01) | |
| *C12N 5/04* | (2006.01) | |

(52) U.S. Cl.
CPC ........... *C12N 15/8261* (2013.01); *A01H 1/02* (2013.01); *C07K 14/415* (2013.01); *C07K 14/81* (2013.01); *C12N 5/04* (2013.01); *C12N 9/0006* (2013.01); *C12N 15/8201* (2013.01); *C12N 15/825* (2013.01); *C12N 15/8271* (2013.01); *C12N 15/8273* (2013.01); *C12Y 101/01049* (2013.01)

(58) Field of Classification Search
None
See application file for complete search history.

(56) References Cited

U.S. PATENT DOCUMENTS

| | | | |
|---|---|---|---|
| 8,697,947 B2 * | 4/2014 | Hatzfeld | C12N 15/8261 435/193 |
| 2003/0233670 A1 | 12/2003 | Edgerton et al. | |
| 2009/0217414 A1 * | 8/2009 | La Rosa | C07H 21/04 800/278 |
| 2011/0179526 A1 | 7/2011 | Sanz Molinero et al. | |
| 2012/0017292 A1 | 1/2012 | Kovalic et al. | |

OTHER PUBLICATIONS

Tamura T et al. Osmotic stress tolerance of transgenic tobacco expressing a gene encoding a membrane-located receptor-like protein from tobacco plants. Plant Physiol. Feb. 2003;131(2):454-62.*
Whisstock J.C. et al. Prediction of protein function from protein sequence and structure. Q Rev Biophys. Aug. 2003;36(3):307-40. Review.*

* cited by examiner

*Primary Examiner* — Cynthia Collins
(74) *Attorney, Agent, or Firm* — Arnold & Porter Kaye Scholer; Lawrence M. Lavin, Jr.; David Marsh

(57) ABSTRACT

This disclosure provides transgenic plants having enhanced traits such as increased yield, increased nitrogen use efficiency and enhanced drought tolerance; propagules, progeny and field crops of such transgenic plants; and methods of making and using such transgenic plants. This disclosure also provides methods of producing hybrid seed from such transgenic plants, growing such seed and selecting progeny plants with enhanced traits. Also disclosed are transgenic plants with altered phenotypes which are useful for screening and selecting transgenic events for the desired enhanced trait.

20 Claims, No Drawings

TRANSGENIC PLANTS WITH ENHANCED TRAITS

REFERENCE TO RELATED APPLICATIONS

This application is National Stage of International Application No. PCT/US2013/029229 filed 06 Mar. 2013, which claims priority to U.S. Provisional Application No. 61/687,209 filed on 20 Apr. 2012, which are incorporated herein by reference.

INCORPORATION OF SEQUENCE LISTING

The Sequence Listing accompanying this application is contained within the computer readable file "38-21(58903) US0001_SeqListing.txt" submitted electronically and contemporaneously with the filing of this application through the USPTO EFS-Web. The file is 604 KB (measured in MS-Windows), was created on 17 Oct. 2014, and is incorporated herein by reference.

FIELD OF THE INVENTION

Disclosed herein are plants having enhanced traits such as increased yield, increased nitrogen use efficiency and increased water use efficiency; propagules, progenies and field crops of such plants; and methods of making and using such plants. Also disclosed are methods of producing seed from such plants, growing such seed and/or selecting progeny plants with enhanced traits.

SUMMARY OF THE INVENTION

An aspect of this disclosure provides a plant comprising a recombinant DNA molecule comprising a polynucleotide encoding a polypeptide, wherein the nucleotide sequence of the polynucleotide is selected from the group consisting of: a) a nucleotide sequence set forth as SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; b) a nucleotide sequence encoding a protein having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; c) a nucleotide sequence with at least 90%, at least 91%, at least 92%, at least 93%, at least 94%, at least 95%, at least 96%, at least 97%, at least 98%, at least 99% identity to SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; d) a nucleotide sequence encoding a protein with at least 90%, at least 91%, at least 92%, at least 93%, at least 94%, at least 95%, at least 96%, at least 97%, at least 98%, at least 99% identity to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; e) a nucleotide sequence encoding a protein with at least 70% identity to one of SEQ ID NO: 76 and 84, wherein said nucleotide sequence encodes a Glucose-6-phosphate 1-dehydrogenase; and 1) a nucleotide sequence encoding a protein with at least 70% identity to one of SEQ ID NO: 76 and 84, and having an amino acid sequence comprising a Pfam domain module of G6PD_N::G6PD_C; wherein said plant has an enhanced trait as compared to a control plant, and wherein said enhanced trait is selected from the group consisting of increased yield, increased nitrogen use efficiency, and increased water use efficiency.

Another aspect of this disclosure provides a plant comprising a recombinant DNA molecule of the disclosure, wherein said plant is a monocot plant or is a member of the family Poaceae, wheat plant, maize plant, sweet corn plant, rice plant, wild rice plant, barley plant, rye, millet plant, sorghum plant, sugar cane plant, turfgrass plant, bamboo plant, oat plant, brome-grass plant, Miscanthus plant, pampas grass plant, switchgrass (*Panicum*) plant, and/or teosinte plant, or is a member of the family Alliaceae, onion plant, leek plant, garlic plant; or wherein the plant is a dicot plant or is a member of the family Amaranthaceae, spinach plant, quinoa plant, a member of the family Anacardiaceae, mango plant, a member of the family Asteraceae, sunflower plant, endive plant, lettuce plant, artichoke plant, a member of the family Brassicaceae, *Arabidopsis thaliana* plant, rape plant, oilseed rape plant, broccoli plant, Brussels sprouts plant, cabbage plant, canola plant, cauliflower plant, kohlrabi plant, turnip plant, radish plant, a member of the family Bromeliaceae, pineapple plant, a member of the family Caricaceae, papaya plant, a member of the family Chenopodiaceae, beet plant, a member of the family Curcurbitaceae, melon plant, cantaloupe plant, squash plant, watermelon plant, honeydew plant, cucumber plant, pumpkin plant, a member of the family Dioscoreaceae, yam plant, a member of the family Ericaceae, blueberry plant, a member of the family Euphorbiaceae, cassava plant, a member of the family Fabaceae, alfalfa plant, clover plant, peanut plant, a member of the family Grossulariaceae, currant plant, a member of the family Juglandaceae, walnut plant, a member of the family Lamiaceae, mint plant, a member of the family Lauraceae, avocado plant, a member of the family Leguminosae, soybean plant, bean plant, pea plant, a member of the family Malvaceae, cotton plant, a member of the family Marantaceae, arrowroot plant, a member of the family Myrtaceae, guava plant, eucalyptus plant, a member of the family Rosaceae, peach plant, apple plant, cherry plant, plum plant, pear plant, prune plant, blackberry plant, raspberry plant, strawberry plant, a member of the family Rubiaceae, coffee plant, a member of the family Rutaceae, citrus plant, orange plant, lemon plant, grapefruit plant, tangerine plant, a member of the family Salicaceae, poplar plant, willow plant, a member of the family Solanaceae, potato plant, sweet potato plant, tomato plant, *Capsicum* plant, tobacco plant, tomatillo plant, eggplant plant, *Atropa belladona* plant, *Datura stramonium* plant, a member of the family Vitaceae, grape plant, a member of the family Umbelliferae, carrot plant, or a member of the family Musaceae, banana plant; or wherein the plant is a member of the family Pinaceae, cedar plant, fir plant, hemlock plant, larch plant, pine plant, or spruce plant.

Another aspect of this disclosure provides a plant comprising a recombinant DNA molecule of the disclosure, wherein the recombinant DNA molecule further comprises a promoter that is operably linked to the polynucleotide encoding a polypeptide, wherein said promoter is selected from the group consisting of a constitutive, inducible, tissue specific, diurnally regulated, tissue enhanced, and cell specific promoter.

Another aspect of this disclosure provides a plant comprising a recombinant DNA molecule of the disclosure, wherein said plant is a progeny, propagule, or field crop. Such field crop is selected from the group consisting of corn, soybean, cotton, canola, rice, barley, oat, wheat, turf grass, alfalfa, sugar beet, sunflower, quinoa and sugar cane.

Another aspect of this disclosure provides a plant comprising a recombinant DNA molecule of the disclosure, wherein said plant is a progeny, propagule, or field crop. Such propagule is selected from the group consisting of a cell, pollen, ovule, flower, embryo, leaf, root, stem, shoot, meristem, grain and seed.

Another aspect of this disclosure provides a method for producing a plant comprising: introducing into a plant cell a recombinant DNA comprising a polynucleotide encoding a polypeptide, wherein the nucleotide sequence of the polynucleotide is selected from the group consisting of: a) a nucleotide sequence set forth as SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; b) a nucleotide sequence encoding a protein having the amino acid sequence of SEQ ID NO: SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; c) a nucleotide sequence with at least 90%, at least 91%, at least 92%, at least 93%, at least 94%, at least 95%, at least 96%, at least 97%, at least 98%, at least 99% identity to SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; a nucleotide sequence encoding a protein with at least 90%, at least 91%, at least 92%, at least 93%, at least 94%, at least 95%, at least 96%, at least 97%, at least 98%, at least 99% identity to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; e) a nucleotide sequence encoding a protein with at least 70% identity to one of SEQ ID NO: 76 and 84, wherein said nucleotide sequence encodes a Glucose-6-phosphate 1-dehydrogenase; and f) a nucleotide sequence encoding a protein with at least 70% identity to one of SEQ ID NO: 76 and 84, and having an amino acid sequence comprising a Pfam domain module of G6PD_N::G6PD_C; and growing a plant from said plant cell.

Another aspect of this disclosure provides a method of producing a plant comprising: introducing into a plant cell a recombinant DNA molecule of the disclosure; growing a plant from said plant cell; and selecting a plant with an enhanced trait selected from increased yield, increased nitrogen use efficiency, and increased water use efficiency as compared to a control plant.

Another aspect of this disclosure provides a method of increasing yield, increasing nitrogen use efficiency, or increasing water use efficiency in a plant comprising: producing a plant comprising a recombinant DNA of the disclosure wherein said plant has an enhanced trait selected from the group consisting of increased yield, increased nitrogen use efficiency, and increased water use efficiency as compared to a control plant; crossing said plant with itself, a second plant from the same plant line, a wild type plant, or a second plant from a different line of plants to produce a seed; growing said seed to produce a plurality of progeny plants, and selecting a progeny plant with increased yield, increased nitrogen use efficiency, or increased water use efficiency.

Another aspect of this disclosure provides a plant comprising a recombinant DNA molecule comprising a polynucleotide encoding a polypeptide, wherein the nucleotide sequence of the polynucleotide is selected from the group consisting of: a) a nucleotide sequence set forth as SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; b) a nucleotide sequence encoding a protein having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; c) a nucleotide sequence with at least 90%, at least 91%, at least 92%, at least 93%, at least 94%, at least 95%, at least 96%, at least 97%, at least 98%, at least 99% identity to SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, or 159; d) a nucleotide sequence encoding a protein with at least 90%, at least 91%, at least 92%, at least 93%, at least 94%, at least 95%, at least 96%, at least 97%, at least 98%, at least 99% identity to SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96-153, 158, 160, or 162-169; e) a nucleotide sequence encoding a protein with at least 70% identity to one of SEQ ID NO: 76 and 84, wherein said nucleotide sequence encodes a Glucose-6-phosphate 1-dehydrogenase; and f) a nucleotide sequence encoding a protein with at least 70% identity to one of SEQ ID NO: 76 and 84, and having an amino acid sequence comprising a Pfam domain module of G6PD_N::G6PD_C; wherein said plant has at least one phenotype selected from the group consisting of anthocyanin, biomass, canopy area, chlorophyll score, plant height, water applied, water content and water use efficiency that is altered for said plant as compared to a control plant.

DETAILED DESCRIPTION OF THE INVENTION

In the attached sequence listing:

SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, and 159 are nucleotide sequences of the coding strand of the DNA molecules used in the recombinant DNA imparting an enhanced trait in plants, each represents a coding sequence for a protein.

SEQ ID NOs: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 158, and 160 are amino acid sequences of the cognate proteins of the DNA molecules with nucleotide sequences 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 157, and 159.

SEQ ID NOs: 97-153, 162-169 are amino acid sequences of homologous proteins.

SEQ ID NOs: 170-205 are amino acid sequences with at least 70% identity to one of SEQ ID NO: 76 and 84, and comprising the Pfam domain module of G6PD_N::G6PD$_{13}$C.

SEQ ID NO: 154 is the nucleotide sequence of the *Zea mays* Nac promoter, P-Zm.Nac.

SEQ ID NO: 155 is the nucleotide sequence of the *Zea mays* Nac leader, L-Zm.Nac.

SEQ ID NO: 156 is the nucleotide sequence of the *Zea mays* HSP70 intron, I-Zm.DnaK.

SEQ ID NO: 161 is the nucleotide sequence of the 3' untranslated region from the pinII proteinase inhibitor (PinII) gene (which directs polyadenylation of mRNA) of *Solanum tuberosum* (potato), T-St.Pis4.

As used herein a "plant" includes whole plant, transgenic plant, meritem, shoot organ/structure (for example, leaf, stem and tuber), root, flower and floral organ/structure (for example, bract, sepal, petal, stamen, carpel, anther and ovule), seed (including embryo, endosperm, and seed coat) and fruit (the mature ovary), plant tissue (for example, vascular tissue, ground tissue, and the like) and cell (for example, guard cell, egg cell, pollen, mesophyll cell, and the like), and progeny of same. The classes of plants that can be used in the disclosed methods are generally as broad as the classes of higher and lower plants amenable to transformation and breeding techniques, including angiosperms (monocotyledonous and dicotyledonous plants), gymnosperms, ferns, horsetails, psilophytes, lycophytes, bryophytes, and multicellular algae.

As used herein a "transgenic plant" means a plant whose genome has been altered by the stable integration of recombinant DNA. A transgenic plant includes a plant regenerated from an originally-transformed plant cell and progeny transgenic plants from later generations or crosses of a transgenic plant.

As used herein a "control plant" means a plant that does not contain the recombinant DNA that imparts an enhanced trait. A control plant is used to identify and select a transgenic plant that has an enhanced trait. A suitable control plant can be a non-transgenic plant of the parental line used to generate a transgenic plant, for example, a wild type plant devoid of a recombinant DNA. A suitable control plant can also be a transgenic plant that contains the recombinant DNA that imparts other traits, for example, a transgenic plant having enhanced herbicide tolerance. A suitable control plant can in some cases be a progeny of a hemizygous transgenic plant line that does not contain the recombinant DNA, known as a negative segregant, or a negative isoline.

As used herein a "transgenic plant cell" means a plant cell that is transformed with stably-integrated, recombinant DNA, for example, by *Agrobacterium*-mediated transformation or by bombardment using microparticles coated with recombinant DNA or by other means. A plant cell of this disclosure can be an originally-transformed plant cell that exists as a microorganism or as a progeny plant cell that is regenerated into differentiated tissue, for example, into a transgenic plant with stably-integrated, recombinant DNA, or seed or pollen derived from a progeny transgenic plant.

As used herein a "propagule" includes all products of meiosis and mitosis, including but not limited to, plant, seed and part of a plant able to propagate a new plant. Propagules include whole plants, cells, pollen, ovules, flowers, embryos, leaves, roots, stems, shoots, meristems, grains or seeds, or any plant part that is capable of growing into an entire plant. Propagule also includes graft where one portion of a plant is grafted to another portion of a different plant (even one of a different species) to create a living organism. Propagule also includes all plants and seeds produced by cloning or by bringing together meiotic products, or allowing meiotic products to come together to form an embryo or a fertilized egg (naturally or with human intervention).

As used herein a "progeny" includes any plant, seed, plant cell, and/or regenerable plant part comprising a recombinant DNA of the present disclosure derived from an ancestor plant. A progeny can be homozygous or heterozygous for the transgene. Progeny can be grown from seeds produced by a transgenic plant comprising a recombinant DNA of the present disclosure, and/or from seeds produced by a plant fertilized with pollen or ovule from a transgenic plant comprising a recombinant DNA of the present disclosure.

As used herein a "trait" is a physiological, morphological, biochemical, or physical characteristic of a plant or particular plant material or cell. In some instances, this characteristic is visible to the human eye, such as seed or plant size, or can be measured by biochemical techniques, such as detecting the protein, starch, certain metabolites, or oil content of seed or leaves, or by observation of a metabolic or physiological process, for example, by measuring tolerance to water deprivation or particular salt or sugar concentrations, or by the measurement of the expression level of a gene or genes, for example, by employing Northern analysis, RT-PCR, microarray gene expression assays, or reporter gene expression systems, or by agricultural observations such as hyperosmotic stress tolerance or yield. Any technique can be used to measure the amount of, comparative level of, or difference in any selected chemical compound or macromolecule in the transgenic plants, however.

As used herein an "enhanced trait" means a characteristic of a transgenic plant as a result of stable integration and expression of a recombinant DNA in the transgenic plant. Such traits include, but are not limited to, an enhanced agronomic trait characterized by enhanced plant morphology, physiology, growth and development, yield, nutritional enhancement, disease or pest resistance, or environmental or chemical tolerance. In some specific aspects of this disclosure an enhanced trait is selected from the group consisting of drought tolerance, increased water use efficiency, cold tolerance, increased nitrogen use efficiency, increased yield, and altered phenotypes as shown in Tables 3-7. In another aspect of the disclosure the trait is increased yield under non-stress conditions or increased yield under environmental stress conditions. Stress conditions can include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, plant biomass, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Also used herein, the term "trait modification" encompasses altering the naturally occurring trait by producing a detectable difference in a characteristic in a plant comprising a recombinant DNA encoding a polypeptide of the present disclosure relative to a plant not comprising the recombinant DNA, such as a wild-type plant, or a negative segregant. In some cases, the trait modification can be evaluated quantitatively. For example, the trait modification can entail an increase or decrease, in an observed trait as compared to a control plant. It is known that there can be natural variations in the modified trait. Therefore, the trait modification observed entails a change of the normal distribution and magnitude of the trait in the plants as compared to a control plant.

Increased yield of a plant of the present disclosure can be measured in a number of ways, including test weight, seed number per plant, seed weight, seed number per unit area (for example, seeds, or weight of seeds, per acre), bushels per acre, tons per acre, or kilo per hectare. For example, corn yield can be measured as production of shelled corn kernels per unit of production area, for example in bushels per acre or metric tons per hectare. This is often also reported on a moisture adjusted basis, for example at 15.5 percent moisture. Increased yield can result from improved utilization of key biochemical compounds, such as nitrogen, phosphorous and carbohydrate, or from improved responses to environmental stresses, such as cold, heat, drought, salt, shade, high plant density, and attack by pests or pathogens. This disclosure can also be used to provide plants with improved growth and development, and ultimately increased yield, as the result of modified expression of plant growth regulators or modification of cell cycle or photosynthesis pathways. Also of interest is the generation of plants that demonstrate increased yield with respect to a seed component that may or may not correspond to an increase in overall plant yield.

The present disclosure relates to a plant with improved economically important characteristics, more specifically increased yield. More specifically the present disclosure relates to a plant comprising a polynucleotide of this disclosure that encodes a polypeptide, wherein the plant has increased yield as compared to a control plant. Many plants of this disclosure exhibited increased yield as compared to a control plant. In an embodiment, a plant of the present disclosure exhibited an improved trait that is a component of yield.

Yield can be defined as the measurable produce of economic value from a crop. Yield can be defined in the scope of quantity and/or quality. Yield can be directly dependent on several factors, for example, the number and size of organs, plant architecture (such as the number of branches, plant biomass, etc.), seed production and more. Root development, photosynthetic efficiency, nutrient uptake, stress tolerance, early vigor, delayed senescence and functional stay green phenotypes can be important factors in determining yield. Optimizing the above mentioned factors can therefore contribute to increasing crop yield.

Reference herein to an increase in yield-related traits can also be taken to mean an increase in biomass (weight) of one or more parts of a plant, which can include above ground and/or below ground (harvestable) plant parts. In particular, such harvestable parts are seeds, and performance of the methods of the disclosure results in plants with increased yield and in particular increased seed yield relative to the seed yield of suitable control plants. The term "yield" of a plant can relate to vegetative biomass (root and/or shoot biomass), to reproductive organs, and/or to propagules (such as seeds) of that plant.

In an embodiment, "alfalfa yield" can also be measured in forage yield, the amount of above ground biomass at harvest. Factors leading contributing to increased biomass include increased vegetative growth, branches, nodes and internodes, leaf area, and leaf area index.

In another embodiment, "canola yield" can also be measured in pod number, number of pods per plant, number of pods per node, number of internodes, incidence of pod shatter, seeds per silique, seed weight per silique, improved seed, oil, or protein composition.

Additionally, "corn or maize yield" can also be measured as production of shelled corn kernels per unit of production area, ears per acre, number of kernel rows per ear, weight per kernel, ear number, fresh or dry ear biomass (weight), kernel rows per ear and kernels per row.

In yet another embodiment, "cotton yield" can be measured as bolls per plant, size of bolls, fiber quality, seed cotton yield in g/plant, seed cotton yield in lb/acre, lint yield in lb/acre, and number of bales.

Specific embodiment for "rice yield" can also include panicles per hill, grain per hill, and filled grains per panicle.

Still further embodiment for "soybean yield" can also include pods per plant, pods per acre, seeds per plant, seeds per pod, weight per seed, weight per pod, pods per node, number of nodes, and the number of internodes per plant.

In still further embodiment, "sugarcane yield" can be measured as cane yield (tons per acre; kg/hectare), total recoverable sugar (pounds per ton), and sugar yield (tons/acre).

In yet still further embodiment, "wheat yield" can include: cereal per unit area, grain number, grain weight, grain size, grains per head, seeds per head, seeds per plant, heads per acre, number of viable tillers per plant, composition of seed (for example, carbohydrates, starch, oil, and protein) and characteristics of seed fill.

The terms "yield", "seed yield" are defined above for a number of core crops. The terms "increased", "improved", "enhanced" are interchangeable and are defined herein.

The present disclosure also provides a method for the production of plants having increased yield. Performance of the method gives plants having increased yield. "Increased yield" can manifest as one or more of the following: (i) increased plant biomass (weight) of one or more parts of a plant, particularly aboveground (harvestable) parts, of a plant, increased root biomass (increased number of roots, increased root thickness, increased root length) or increased biomass of any other harvestable part; (ii) increased early vigor, defined herein as an improved seedling aboveground area approximately three weeks post-germination. "Early vigor" refers to active healthy plant growth especially during early stages of plant growth, and can result from increased plant fitness due to, for example, the plants being better adapted to their environment (for example, optimizing the use of energy resources, uptake of nutrients and partitioning carbon allocation between shoot and root). Early vigor in corn, for example, is a combination of the ability of corn seeds to germinate and emerge after planting and the ability of the young corn plants to grow and develop after emergence. Plants having early vigor also show increased seedling survival and better establishment of the crop, which often results in highly uniform fields with the majority of the plants reaching the various stages of development at substantially the same time, which often results in increased yield. Therefore early vigor can be determined by measuring various factors, such as kernel weight, percentage germination, percentage emergence, seedling growth, seedling height, root length, root and shoot biomass, canopy size and color and others; (iii) increased total seed yield, which includes an increase in seed biomass (seed weight) and which can be an increase in the seed weight per plant or on an individual seed basis; increased number of panicles per plant; increased pods, increased number of nodes, increased number of flowers ("florets") per panicle/plant; increased seed fill rate; increased number of filled seeds; increased seed size (length, width, area, perimeter), which can also influence the composition of seeds; increased seed volume, which can also influence the composition of seeds. Increased yield can also result in modified architecture, or can occur because of modified plant architecture; (iv) increased harvest index, which is expressed as a ratio of the yield of harvestable parts, such as seeds, over the total biomass; and (v) increased kernel weight, which is extrapolated from the number of filled seeds counted and their total weight. An increased kernel weight can result from an increased seed size and/or seed weight, an increase in embryo size, endosperm size, aleurone and/or scutellum, or other parts of the seed.

In one embodiment, increased yield can be increased seed yield, and is selected from one of the following: (i) increased seed weight; (ii) increased number of filled seeds; and (iii) increased harvest index.

The disclosure also extends to harvestable parts of a plant such as, but not limited to, seeds, leaves, fruits, flowers, bolls, stems, rhizomes, tubers and bulbs. The disclosure furthermore relates to products derived from a harvestable part of such a plant, such as dry pellets, powders, oil, fat and fatty acids, starch or proteins.

The present disclosure provides a method for increasing "yield" of a plant or "broad acre yield" of a plant or plant part defined as the harvestable plant parts per unit area, for example seeds, or weight of seeds, per acre, pounds per acre, bushels per acre, tones per acre, tons per acre, kilo per hectare.

This disclosure further provides a method of increasing yield in a plant by producing a plant comprising a polynucleic acid sequence encoding a polypeptide of this disclosure where the plant can be crossed with itself, a second plant from the same plant line, a wild type plant, or a plant from a different line of plants to produce a seed. The seed of the resultant plant can be harvested from fertile plants and be used to grow progeny generations of plant(s) of this disclosure. In addition to direct transformation of a plant with a recombinant DNA, transgenic plants can be prepared by crossing a first plant having a recombinant DNA with a second plant lacking the DNA. For example, recombinant DNA can be introduced into a first plant line that is amenable to transformation to produce a transgenic plant which can be crossed with a second plant line to introgress the recombinant DNA into the second plant line. A transgenic plant with a recombinant DNA having the polynucleotide of this disclosure provides the enhanced trait of increased yield compared to a control plant. Genetic markers associated with recombinant DNA can produce transgenic progeny that is homozygous for the desired recombinant DNA. Progeny plants carrying DNA for both parental traits can be back crossed into a parent line multiple times, for example usually 6 to 8 generations, to produce a progeny plant with substantially the same genotype as the one original transgenic parental line but having the recombinant DNA of the other transgenic parental line. The term "progeny" denotes the offspring of any generation of a parent plant prepared by the methods of this disclosure containing the recombinant polynucleotides as described herein.

As used herein "nitrogen use efficiency" refers to the processes which lead to an increase in the plant's yield, biomass, vigor, and growth rate per nitrogen unit applied. The processes can include the uptake, assimilation, accumulation, signaling, sensing, retranslocation (within the plant) and use of nitrogen by the plant.

As used herein "nitrogen limiting conditions" refers to growth conditions or environments that provide less than optimal amounts of nitrogen needed for adequate or successful plant metabolism, growth, reproductive success and/or viability.

As used herein the "increased nitrogen stress tolerance" refers to the ability of plants to grow, develop, or yield normally, or grow, develop, or yield faster or better when subjected to less than optimal amounts of available/applied nitrogen, or under nitrogen limiting conditions.

As used herein "increased nitrogen use efficiency" refers to the ability of plants to grow, develop, or yield faster or better than normal when subjected to the same amount of available/applied nitrogen as under normal or standard conditions; ability of plants to grow, develop, or yield normally, or grow, develop, or yield faster or better when subjected to less than optimal amounts of available/applied nitrogen, or under nitrogen limiting conditions.

Increased plant nitrogen use efficiency can be translated in the field into either harvesting similar quantities of yield, while supplying less nitrogen, or increased yield gained by supplying optimal/sufficient amounts of nitrogen. The increased nitrogen use efficiency can improve plant nitrogen stress tolerance, and can also improve crop quality and biochemical constituents of the seed such as protein yield and oil yield. The terms "increased nitrogen use efficiency", "enhanced nitrogen use efficiency", and "nitrogen stress tolerance" are used inter-changeably in the present disclosure to refer to plants with improved productivity under nitrogen limiting conditions.

As used herein "water use efficiency" refers to the amount of carbon dioxide assimilated by leaves per unit of water vapor transpired. It constitutes one of the most important traits controlling plant productivity in dry environments. "Drought tolerance" refers to the degree to which a plant is adapted to arid or drought conditions. The physiological responses of plants to a deficit of water include leaf wilting, a reduction in leaf area, leaf abscission, and the stimulation of root growth by directing nutrients to the underground parts of the plants. Plants are more susceptible to drought during flowering and seed development the reproductive stages), as plant's resources are deviated to support root growth. In addition, abscisic acid (ABA), a plant stress hormone, induces the closure of leaf stomata (microscopic pores involved in gas exchange), thereby reducing water loss through transpiration, and decreasing the rate of photosynthesis. These responses improve the water-use efficiency of the plant on the short term. The terms "increased water use efficiency", "enhanced water use efficiency", and "increased drought tolerance" are used inter-changeably in the present disclosure to refer to plants with improved productivity under water-limiting conditions.

As used herein "increased water use efficiency" refers to the ability of plants to grow, develop, or yield faster or better than normal when subjected to the same amount of available/applied water as under normal or standard conditions; ability of plants to grow, develop, or yield normally, or grow, develop, or yield faster or better when subjected to reduced amounts of available/applied water (water input) or under conditions of water stress or water deficit stress.

As used herein "increased drought tolerance" refers to the ability of plants to grow, develop, or yield normally, or grow, develop, or yield faster or better than normal when subjected to reduced amounts of available/applied water and/or under conditions of acute or chronic drought; ability of plants to grow, develop, or yield normally when subjected to reduced amounts of available/applied water (water input) or under conditions of water deficit stress or under conditions of acute or chronic drought.

As used herein "drought stress" refers to a period of dryness (acute or chronic/prolonged) that results in water deficit and subjects plants to stress and/or damage to plant tissues and/or negatively affects grain/crop yield; a period of dryness (acute or chronic/prolonged) that results in water deficit and/or higher temperatures and subjects plants to stress and/or damage to plant tissues and/or negatively affects grain/crop yield.

As used herein "water deficit" refers to the conditions or environments that provide less than optimal amounts of water needed for adequate/successful growth and development of plants.

As used herein "water stress" refers to the conditions or environments that provide improper (either less/insufficient or more/excessive) amounts of water than that needed for adequate/successful growth and development of plants/crops thereby subjecting the plants to stress and/or damage to plant tissues and/or negatively affecting grain/crop yield.

As used herein "water deficit stress" refers to the conditions or environments that provide less/insufficient amounts of water than that needed for adequate/successful growth and development of plants/crops thereby subjecting the plants to stress and/or damage to plant tissues and/or negatively affecting grain yield.

As used herein a "polynucleotide" is a nucleic acid molecule comprising a plurality of polymerized nucleotides. A polynucleotide may be referred to as a nucleic acid, oligonucleotide, nucleotide, or any fragment thereof. In many instances, a polynucleotide encodes a polypeptide (or protein) or a domain or fragment thereof. Additionally, a polynucleotide can comprise a promoter, an intron, an enhancer region, a polyadenylation site, a translation initiation site, 5' or 3' untranslated regions, a reporter gene, a selectable marker, a scorable marker, or the like. A polynucleotide can be single-stranded or double-stranded DNA or RNA. A polynucleotide optionally comprises modified bases or a modified backbone. A polynucleotide can be, for example, genomic DNA or RNA, a transcript (such as an mRNA), a cDNA, a PCR product, a cloned DNA, a synthetic DNA or RNA, or the like. A polynucleotide can be combined with carbohydrate(s), lipid(s), protein(s), or other materials to perform a particular activity such as transformation or form a composition such as a peptide nucleic acid (PNA). A polynucleotide can comprise a sequence in either sense or antisense orientations. "Oligonucleotide" is substantially equivalent to the terms amplimer, primer, oligomer, element, target, and probe and is preferably single-stranded.

As used herein a "recombinant polynucleotide" or "recombinant DNA" is a polynucleotide that is not in its native state, for example, a polynucleotide comprises a series of nucleotides (represented as a nucleotide sequence) not found in nature, or a polynucleotide is in a context other than that in which it is naturally found; for example, separated from polynucleotides with which it typically is in proximity in nature, or adjacent (or contiguous with) polynucleotides with which it typically is not in proximity. The "recombinant polynucleotide" or "recombinant DNA" refers to polynucleotide or DNA which has been genetically engineered and constructed outside of a cell including DNA containing naturally occurring DNA or cDNA or synthetic DNA. For example, the polynucleotide at issue can be cloned into a vector, or otherwise recombined with one or more additional nucleic acids.

As used herein a "polypeptide" comprises a plurality of consecutive polymerized amino acid residues for example, at least about 15 consecutive polymerized amino acid residues. In many instances, a polypeptide comprises a series of polymerized amino acid residues that is a transcriptional regulator or a domain or portion or fragment thereof. Additionally, the polypeptide can comprise: (i) a localization domain; (ii) an activation domain; (iii) a repression domain; (iv) an oligomerization domain; (v) a protein-protein interaction domain; (vi) a DNA-binding domain; or the like. The polypeptide optionally comprises modified amino acid residues, naturally occurring amino acid residues not encoded by a codon, non-naturally occurring amino acid residues.

As used herein "protein" refers to a series of amino acids, oligopeptide, peptide, polypeptide or portions thereof whether naturally occurring or synthetic.

Recombinant DNA constructs are assembled using methods known to persons of ordinary skill in the art and typically comprise a promoter operably linked to DNA, the expression of which provides the enhanced agronomic trait. Other construct components can include additional regulatory elements, such as 5' leaders and introns for enhancing transcription, 3' untranslated regions (such as polyadenylation signals and sites), and DNA for transit or targeting or signal peptides.

As used herein a "recombinant polypeptide" is a polypeptide produced by translation of a recombinant polynucleotide.

A "synthetic polypeptide" is a polypeptide created by consecutive polymerization of isolated amino acid residues using methods known in the art.

An "isolated polypeptide", whether a naturally occurring or a recombinant polypeptide, is more enriched in (or out of) a cell than the polypeptide in its natural state in a wild-type cell, for example, more than about 5% enriched, more than about 10% enriched, or more than about 20%, or more than about 50%, or more, enriched, for example, alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, for example, by any of the various protein purification methods.

A "DNA construct" as used in the present disclosure comprises at least one expression cassette having a promoter operable in plant cells and a polynucleotide of the present disclosure encoding a protein or variant of a protein or fragment of a protein that is functionally defined to maintain activity in transgenic host cells including plant cells, plant parts, explants and plants. DNA constructs are made that contain various genetic elements necessary for the expression of noncoding and coding polynucleotides in plants. Promoters, leaders, enhancers, introns, transit or targeting or signal peptides, 3' transcriptional termination regions are genetic elements that can be operably linked in a DNA construct.

Percent identity describes the extent to which polynucleotides or protein segments are invariant in an alignment of sequences, for example nucleotide sequences or amino acid sequences. An alignment of sequences is created by manually aligning two sequences, for example, a stated sequence, as provided herein, as a reference, and another sequence, to produce the highest number of matching elements, for example, individual nucleotides or amino acids, while allowing for the introduction of gaps into either sequence. An "identity fraction" for a sequence aligned with a reference sequence is the number of matching elements, divided by the full length of the reference sequence, not including gaps introduced by the alignment process into the reference sequence. "Percent identity" ("% identity") as used herein is the identity fraction times 100.

As used herein, a "functional fragment" refers to a portion of a polypeptide provided herein which retains full or partial molecular, physiological or biochemical function of the full length polypeptide. A functional fragment often contains the domain(s), such as Pfam domains, identified in the polypeptide provided in the sequence listing.

As used herein, a "homolog" or "homologues" means a protein in a group of proteins that perform the same biological function, for example, proteins that belong to the same Pfam protein family and that provide a common enhanced trait in transgenic plants of this disclosure. Homologs are expressed by homologous genes. With reference to homologous genes, homologs include orthologs, for example, genes expressed in different species that evolved from a common ancestral genes by speciation and encode proteins retain the same function, but do not include paralogs, for example, genes that are related by duplication but have evolved to encode proteins with different functions. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. When optimally aligned, homolog proteins, or their corresponding nucleotide sequences, have typically at least about 60% identity, in some instances at least about 70%, at least about 75%, at least about bout 80%, at least about 85%, at least about 90%, at least about bout 92%, at least about bout 94%, at least about bout 95%, at least about 96%, at least about 97%, at least about 98%, at least about 99%, and even at least about 99.5% identity over the full length of a protein or its corresponding nucleotide sequence identified as being associated with imparting an enhanced trait when expressed in plant cells. In one aspect of the disclosure homolog proteins have at least about 80%, at least about 85%, at least about 90%, at least about 92%, at least about 94%, at least about 95%, at least about 96%, at least about 97%, at least about 98%, at least about 99%, and at least about 99.5% identity to a consensus amino acid sequence of proteins and homologs that can be built from sequences disclosed herein.

Homologs are inferred from sequence similarity, by comparison of protein sequences, for example, manually or by use of a computer-based tool using known sequence comparison algorithms such as BLAST and FASTA. A sequence search and local alignment program, for example, BLAST, can be used to search query protein sequences of a base organism against a database of protein sequences of various organisms, to find similar sequences, and the summary Expectation value (E-value) can be used to measure the level of sequence similarity. Because a protein hit with the lowest E-value for a particular organism may not necessarily be an ortholog or be the only ortholog, a reciprocal query is used to filter hit sequences with significant E-values for ortholog identification. The reciprocal query entails search of the significant hits against a database of protein sequences of the base organism. A hit can be identified as an ortholog, when the reciprocal query's best hit is the query protein itself or a paralog of the query protein. With the reciprocal query process orthologs are further differentiated from paralogs among all the homologs, which allows for the inference of functional equivalence of genes. A further aspect of the homologs encoded by DNA useful in the transgenic plants of the invention are those proteins that differ from a disclosed protein as the result of deletion or insertion of one or more amino acids in a native sequence.

Other functional homolog proteins differ in one or more amino acids from those of a trait-improving protein disclosed herein as the result of one or more of known conservative amino acid substitutions, for example, valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native protein or polypeptide can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side 30 chains is cysteine and methionine. Naturally conservative amino acids substitution groups are: valine-leucine, valine-isoleucine, phenylalanine-tyrosine, lysine-arginine, alaninevaline, aspartic acid-glutamic acid, and asparagine-glutamine. A further aspect of the disclosure includes proteins that differ in one or more amino acids from those of a described protein sequence as the result of deletion or insertion of one or more amino acids in a native sequence.

"Pfam" is a large collection of multiple sequence alignments and hidden Markov models covering many common protein families, for example, Pfam version 26.0 (November, 2011) contains alignments and models for 13672 protein families and uses UniProtKB as its reference sequence databases. See *The Pfam protein families database*: M. Punta, P. C. Coggill, R. Y. Eberhardt, J. Mistry, J. Tate, C. Boursnell, N. Pang, K. Forslund, G. Ceric, J. Clements, A. Heger, L. Holm, E. L. L. Sonnhammer, S. R. Eddy, A. Bateman, R. D. Finn Nucleic Acids Research (2012) Database Issue 40:D290-D30, which is incorporated herein by reference in its entirety. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

Protein domains are identified by querying the amino acid sequence of a protein against Hidden Markov Models which characterize protein family domains ("Pfam domains") using HMMER software, which is available from the Pfam Consortium. The HMMER software is also disclosed in patent application publication US 2008/0148432 A1 incorporated herein by reference. A protein domain meeting the gathering cutoff for the alignment of a particular Pfam domain is considered to contain the Pfam domain.

A "Pfam domain module" is a representation of Pfam domains in a protein, in order from N terminus to C terminus. In a Pfam domain module individual Pfam domains are separated by double colons "::". The order and copy number of the Pfam domains from N to C terminus are attributes of a Pfam domain module. Although the copy number of repetitive domains is important, varying copy number often enables a similar function. Thus, a Pfam domain module with multiple copies of a domain should define an equivalent Pfam domain module with variance in the number of multiple copies. A Pfam domain module is not specific for distance between adjacent domains, but contemplates natural distances and variations in distance that provide equivalent function. The Pfam database contains both narrowly- and broadly-defined domains, leading to identification of overlapping domains on some proteins. A Pfam domain module is characterized by non-overlapping domains. Where there is overlap, the domain having a function that is more closely associated with the function of the protein (based on the E value of the Pfam match) is selected.

Once one DNA is identified as encoding a protein which imparts an enhanced trait when expressed in transgenic plants, other DNA encoding proteins with the same Pfam domain module are identified by querying the amino acid sequence of protein encoded by the candidate DNA against the Hidden Markov Models which characterizes the Pfam domains using HMMER software. Candidate proteins meeting the same Pfam domain module are in the protein family and have cognate DNA that is useful in constructing recombinant DNA for the use in the plant cells of this disclosure. Hidden Markov Model databases for the use with HMMER software in identifying DNA expressing protein with a common Pfam domain module for recombinant DNA in the plant cells of this disclosure are included in the computer program listing in this application.

In general, the term "variant" refers to molecules with some differences, generated synthetically or naturally, in their nucleotide or amino acid sequences as compared to a reference (native) polynucleotides or polypeptides, respectively. These differences include substitutions, insertions, deletions or any desired combinations of such changes in a native polynucleotide or amino acid sequence.

With regard to polynucleotide variants, differences between presently disclosed polynucleotides and polynucleotide variants are limited so that the nucleotide sequences of the former and the latter are similar overall and, in many regions, identical. Due to the degeneracy of the genetic code, differences between the former and the latter nucleotide sequences may be silent (for example, the amino acids encoded by the polynucleotide are the same, and the variant polynucleotide sequence encodes the same amino acid sequence as the presently disclosed polynucleotide). Variant nucleotide sequences can encode different amino acid sequences, in which case such nucleotide differences will result in amino acid substitutions, additions, deletions, insertions, truncations or fusions with respect to the similarly disclosed polynucleotide sequences. These variations can result in polynucleotide variants encoding polypeptides that share at least one functional characteristic. The degeneracy of the genetic code also dictates that many different variant polynucleotides can encode identical and/or substantially similar polypeptides.

As used herein "gene" or "gene sequence" refers to the partial or complete coding sequence of a gene, its complement, and its 5' and/or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter can be subjected to subsequent processing such as chemical modification or folding to obtain a functional protein or polypeptide. By way of example, a transcriptional regulator gene encodes a transcriptional regulator polypeptide, which can be functional or require processing to function as an initiator of transcription.

As used herein, the term "promoter" refers generally to a DNA molecule that is involved in recognition and binding of RNA polymerase II and other proteins (trans-acting transcription factors) to initiate transcription. A promoter can be initially isolated from the 5' untranslated region (5' UTR) of a genomic copy of a gene. Alternately, promoters can be synthetically produced or manipulated DNA molecules. Promoters can also be chimeric, that is a promoter produced through the fusion of two or more heterologous DNA molecules. Plant promoters include promoter DNA obtained from plants, plant viruses, fungi and bacteria such as *Agrobacterium* and *Bradyrhizobium* bacteria.

Promoters which initiate transcription in all or most tissues of the plant are referred to as "constitutive" promoters. Promoters which initiate transcription during certain periods or stages of development are referred to as "developmental" promoters. Promoters whose expression is enhanced in certain tissues of the plant relative to other plant tissues are referred to as "tissue enhanced" or "tissue preferred" promoters. Promoters which express within a specific tissue of the plant, with little or no expression in other plant tissues are referred to as "tissue specific" promoters. A promoter that expresses in a certain cell type of the plant, for example a microspore mother cell, is referred to as a "cell type specific" promoter. An "inducible" promoter is a promoter in which transcription is initiated in response to an environmental stimulus such as cold, drought or light; or other stimuli such as wounding or chemical application. Many physiological and biochemical processes in plants exhibit endogenous rhythms with a period of about 24 hours. A "diurnal promoter" is a promoter which exhibits altered expression profiles under the control of a circadian oscillator. Diurnal regulation is subject to environmental inputs such as light and temperature and coordination by the circadian clock. An example of a tissue enhanced promoter useful in the present disclosure which demonstrates enhanced expression in the developing and germinating seed is the *Zea mays* Nac promoter, P-Zm.Nac (disclosed herein as SEQ ID NO: 154).

Sufficient expression in plant seed tissues is desired to affect improvements in seed composition. Exemplary promoters for use for seed composition modification include promoters from seed genes such as napin as disclosed in U.S. Pat. No. 5,420,034, maize L3 oleosin as disclosed in U.S. Pat. No. 6,433,252, zein Z27 as disclosed by Russell et al. (1997) *Transgenic Res.* 6(2):157-166, globulin 1 as disclosed by Belanger et al (1991) *Genetics* 129:863-872, glutelin 1 as disclosed by Russell (1997) supra, and peroxiredoxin antioxidant (Per1) as disclosed by Stacy et al. (1996) *Plant Mol Biol.* 31(6):1205-1216.

As used herein, the term "leader" refers to a DNA molecule isolated from the untranslated 5' region (5' UTR) of a genomic copy of a gene and is defined generally as a nucleotide segment between the transcription start site (TSS) and the protein coding sequence start site. Alternately, leaders can be synthetically produced or manipulated DNA elements. A leader can be used as a 5' regulatory element for modulating expression of an operably linked transcribable polynucleotide molecule. An example of a leader sequence useful in the present disclosure is the *Zea mays* Nac leader, L-Zm.Nac (disclosed herein as SEQ ID NO: 155).

As used herein, the term "intron" refers to a DNA molecule that can be isolated or identified from the genomic copy of a gene and can be defined generally as a region spliced out during mRNA processing prior to translation. Alternately, an intron can be a synthetically produced or manipulated DNA element. An intron can contain enhancer elements that effect the transcription of operably linked genes. An intron can be used as a regulatory element for modulating expression of an operably linked transcribable polynucleotide molecule. A DNA construct can comprise an intron, and the intron may or may not be heterologous with respect to the transcribable polynucleotide molecule. An example of an intron useful in the present disclosure is the Zea mays HSP70 intron (U.S. Pat. No. 5,859,347), I-Zm.DnaK (disclosed herein as SEQ ID NO: 156)

As used herein, the term "enhancer" or "enhancer element" refers to a cis-acting transcriptional regulatory element, a.k.a. cis-element, which confers an aspect of the overall expression pattern, but is usually insufficient alone to drive transcription, of an operably linked polynucleotide. Unlike promoters, enhancer elements do not usually include a transcription start site (TSS) or TATA box or equivalent sequence. A promoter can naturally comprise one or more enhancer elements that affect the transcription of an operably linked polynucleotide. An isolated enhancer element can also be fused to a promoter to produce a chimeric promoter cis-element, which confers an aspect of the overall modulation of gene expression. A promoter or promoter fragment can comprise one or more enhancer elements that effect the transcription of operably linked genes. Many promoter enhancer elements are believed to bind DNA-binding proteins and/or affect DNA topology, producing local conformations that selectively allow or restrict access of RNA polymerase to the DNA template or that facilitate selective opening of the double helix at the site of transcriptional initiation. An enhancer element can function to bind transcription factors that regulate transcription. Some enhancer elements bind more than one transcription factor, and transcription factors can interact with different affinities with more than one enhancer domain.

Expression cassettes of this disclosure can include a "transit peptide" or "targeting peptide" or "signal peptide" molecule located either 5' or 3' to or within the gene(s). These terms generally refer to peptide molecules that when linked to a protein of interest directs the protein to a particular tissue, cell, subcellular location, or cell organelle. Examples include, but are not limited to, chloroplast transit peptides (CTPs), chloroplast targeting peptides, mitochondrial targeting peptides, nuclear targeting signals, nuclear exporting signals, vacuolar targeting peptides, vacuolar sorting peptides. For description of the use of chloroplast transit peptides see U.S. Pat. No. 5,188,642 and U.S. Pat. No. 5,728,925. For description of the transit peptide region of an Arabidopsis EPSPS gene in the present disclosure, see Klee, H. J. et al (MGG (1987) 210:437-442. Expression cassettes of this disclosure can also include an intron or introns. Expression cassettes of this disclosure can contain a DNA near the 3' end of the cassette that acts as a signal to terminate transcription from a heterologous nucleic acid and that directs polyadenylation of the resultant mRNA. These are commonly referred to as "3'-untranslated regions" or "3'-non-coding sequences" or "3'-UTRs". The "3' non-translated sequences" means DNA sequences located downstream of a structural nucleotide sequence and include sequences encoding polyadenylation and other regulatory signals capable of affecting mRNA processing or gene expression. The polyadenylation signal functions in plants to cause the addition of polyadenylate nucleotides to the 3' end of the mRNA precursor. The polyadenylation signal can be derived from a natural gene, from a variety of plant genes, or from T-DNA. An example of a polyadenylation sequence is the nopaline synthase 3' sequence (nos 3'; Fraley et al., Proc. Natl. Acad. Sci. USA 80: 4803-4807, 1983). The use of different 3' non-translated sequences is exemplified by Ingelbrecht et al., Plant Cell 1:671-680, 1989.

Expression cassettes of this disclosure can also contain one or more genes that encode selectable markers and confer resistance to a selective agent such as an antibiotic or a herbicide. A number of selectable marker genes are known in the art and can be used in the present disclosure: selectable marker genes conferring tolerance to antibiotics like kanamycin and paromomycin (nptII), hygromycin B (aph IV), spectinomycin (aadA), U.S. Patent Publication 2009/0138985A1 and gentamycin (aac3 and aacC4) or tolerance to herbicides like glyphosate (for example, 5-enolpyruvyl-shikimate-3-phosphate synthase (EPSPS), U.S. Pat. No. 5,627,061; U.S. Pat. No. 5,633,435; U.S. Pat. No. 6,040,497; U.S. Pat. No. 5,094,945), sulfonyl herbicides (for example, acetohydroxyacid synthase or acetolactate synthase conferring tolerance to acetolactate synthase inhibitors such as sulfonylurea, imidazolinone, triazolopyrimidine, pyrimidyloxybenzoates and phthalide (U.S. Pat. Nos. 6,225,105; 5,767,366; 4,761,373; 5,633,437; 6,613,963; 5,013,659; 5,141,870; 5,378,824; 5,605,011)), bialaphos or phosphinothricin or derivatives (e.g., phosphinothricin acetyltransferase (bar) tolerance to phosphinothricin or glufosinate (U.S. Pat. Nos. 5,646,024; 5,561,236; 5,276,268; 5,637,489; 5,273,894); dicamba (dicamba monooxygenase, Patent Application Publications US2003/0115626A1), or sethoxydim (modified acetyl-coenzyme A carboxylase for conferring tolerance to cyclohexanedione (sethoxydim)), and aryloxyphenoxypropionate (haloxyfop, U.S. Pat. No. 6,414,222).

Transformation vectors of this disclosure can contain one or more "expression cassettes", each comprising a native or non-native plant promoter operably linked to a polynucleotide sequence of interest, which is operably linked to a 3' UTR termination signal, for expression in an appropriate host cell. It also typically comprises sequences required for proper translation of the polynucleotide or transgene. As used herein, the term "transgene" refers to a polynucleotide molecule artificially incorporated into a host cell's genome. Such a transgene can be heterologous to the host cell. The term "transgenic plant" refers to a plant comprising such a transgene. The coding region usually codes for a protein of interest but can also code for a functional RNA of interest, for example an antisense RNA, a nontranslated RNA, in the sense or antisense direction, a microRNA, a noncoding RNA, or a synthetic RNA used in either suppression or over expression of target gene sequences. The expression cassette comprising the nucleotide sequence of interest can be chimeric, meaning that at least one of its components is heterologous with respect to at least one of its other components. As used herein the term "chimeric" refers to a DNA molecule that is created from two or more genetically diverse sources, for example a first molecule from one gene or organism and a second molecule from another gene or organism.

Recombinant DNA constructs in this disclosure generally include a 3' element that typically contains a polyadenylation signal and site. Known 3' elements include those from Agrobacterium tumefaciens genes such as nos 3', tml 3', tmr 3', tms 3', ocs 3', tr7 3', for example disclosed in U.S. Pat. No. 6,090,627; 3' elements from plant genes such as wheat (Triticum aesevitum) heat shock protein 17 (Hsp17 3'), a wheat ubiquitin gene, a wheat fructose-1,6-biphosphatase gene, a rice glutelin gene, a rice lactate dehydrogenase gene and a rice beta-tubulin gene, all of which are disclosed in US Patent Application Publication 2002/0192813 A1; and the pea (*Pisum sativum*) ribulose biphosphate carboxylase gene (rbs 3'), and 3' elements from the genes within the host plant.

As used herein "operably linked" means the association of two or more DNA fragments in a recombinant DNA construct so that the function of one, for example, protein-encoding DNA, is controlled by the other, for example, a promoter.

As used herein "expressed" means produced, for example, a protein is expressed in a plant cell when its cognate DNA is transcribed to mRNA that is translated to the protein. An "expressed" protein can also include its truncated version (for example, N-terminal truncated, C-terminal truncated or internal truncated) as long as the truncated version maintains the same or similar functionality as the full length version.

Transgenic plants can comprise a stack of one or more polynucleotides disclosed herein resulting in the production of multiple polypeptide sequences. Transgenic plants comprising stacks of polynucleotides can be obtained by either or both of traditional breeding methods or through genetic engineering methods. These methods include, but are not limited to, crossing individual transgenic lines each comprising a polynucleotide of interest, transforming a transgenic plant comprising a first gene disclosed herein with a second gene, and co-transformation of genes into a single plant cell. Co-transformation of genes can be carried out using single transformation vectors comprising multiple genes or genes carried separately on multiple vectors.

Transgenic plants comprising or derived from plant cells of this disclosure transformed with recombinant DNA can be further enhanced with stacked traits, for example, a crop plant having an enhanced trait resulting from expression of DNA disclosed herein in combination with herbicide and/or pest resistance traits. For example, genes of the current disclosure can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects, or improved quality traits such as improved nutritional value. Herbicides for which transgenic plant tolerance has been demonstrated and the method of the present disclosure can be applied include, but are not limited to, glyphosate, dicamba, glufosinate, sulfonylurea, bromoxynil and norflurazon herbicides. Polynucleotide molecules encoding proteins involved in herbicide tolerance known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in US Patent Application Publication 2003/0083480 A1 also for imparting glyphosate tolerance; dicamba monooxygenase disclosed in US Patent Application Publication 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtl) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in US Patent Application Publication 2003/010609 A1 for imparting N-amino methyl phosphonic acid tolerance; polynucleotide molecules disclosed in U.S. Pat. No. 6,107,549 for imparting pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and US Patent Application Publication 2002/0112260. Molecules and methods for imparting insect/nematode/virus resistance are disclosed in U.S. Pat. Nos. 5,250,515; 5,880,275; 6,506,599; 5,986,175 and US Patent Application Publication 2003/0150017 A1.

Plant Cell Transformation Methods

Numerous methods for transforming chromosomes in a plant cell with recombinant DNA are known in the art and are used in methods of producing a transgenic plant cell and plant. Two effective methods for such transformation are *Agrobacterium*-mediated transformation and microprojectile bombardment-mediated transformation. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice). *Agrobacterium*-mediated transformation methods are described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 5,846,797 (cotton); U.S. Pat. No. 6,384,301 (soybean), U.S. Pat. No. 7,026,528 (wheat) and U.S. Pat. No. 6,329,571 (rice), US Patent Application Publication 2004/0087030 A1 (cotton), and US Patent Application Publication 2001/0042257 A1 (sugar beet), all of which are incorporated herein by reference in their entirety. Transformation of plant material is practiced in tissue culture on nutrient media, for example a mixture of nutrients that allow cells to grow in vitro. Recipient cell targets include, but are not limited to, meristem cells, shoot tips, hypocotyls, calli, immature or mature embryos, and gametic cells such as microspores, pollen, sperm and egg cells. Callus can be initiated from tissue sources including, but not limited to, immature or mature embryos, hypocotyls, seedling apical meristems, microspores and the like. Cells containing a transgenic nucleus are grown into transgenic plants.

In addition to direct transformation of a plant material with a recombinant DNA, a transgenic plant can be prepared by crossing a first plant comprising a recombinant DNA with a second plant lacking the recombinant DNA. For example, recombinant DNA can be introduced into a first plant line that is amenable to transformation, which can be crossed with a second plant line to introgress the recombinant DNA into the second plant line. A transgenic plant with recombinant DNA providing an enhanced trait, for example, enhanced yield, can be crossed with a transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, for example, marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as the original transgenic parental line but for the recombinant DNA of the other transgenic parental line.

For transformation, DNA is typically introduced into only a small percentage of target plant cells in any one transformation experiment. Marker genes are used to provide an efficient system for identification of those cells that are stably transformed by receiving and integrating a recombinant DNA molecule into their genomes. Preferred marker genes provide selective markers which confer resistance to a selective agent, such as an antibiotic or a herbicide. Any of the herbicides to which plants of this disclosure can be resistant is a agent for selective markers. Potentially transformed cells are exposed to the selective agent. In the population of surviving cells are those cells where, generally, the resistance-conferring gene is integrated and expressed at sufficient levels to permit cell survival. Cells can be tested further to confirm stable integration of the exogenous DNA. Commonly used selective marker genes include those conferring resistance to antibiotics such as kanamycin and paromomycin (nptII), hygromycin B (aph IV), spectinomycin (aadA) and gentamycin (aac3 and aacC4) or resistance to herbicides such as glufosinate (bar or pat), dicamba (DMO) and glyphosate (aroA or EPSPS). Examples of such selectable markers are illustrated in U.S. Pat. Nos. 5,550,318; 5,633,435; 5,780,708 and 6,118,047. Markers which provide an ability to visually screen transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to a selective agent, or plant cells that have been scored positive in a screening assay, may be cultured in vitro to regenerate plantlets. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}$ $s^{-1}$ of light, prior to transfer to a greenhouse or growth chamber for maturation. Plants are regenerated from about 6 weeks to 10 months after a transformant is identified, depending on the initial tissue, and plant species. Plants can be pollinated using conventional plant breeding methods known to those of skill in the art to produce seeds, for example self-pollination is commonly used with transgenic corn. The regenerated transformed plant or its progeny seed or plants can be tested for expression of the recombinant DNA and selected for the presence of an enhanced agronomic trait.

Transgenic Plants and Seeds

Transgenic plants derived from transgenic plant cells having a transgenic nucleus of this disclosure are grown to generate transgenic plants having an enhanced trait as compared to a control plant, and produce transgenic seed and haploid pollen of this disclosure. Such plants with enhanced traits are identified by selection of transformed plants or progeny seed for the enhanced trait. For efficiency a selection method is designed to evaluate multiple transgenic plants (events) comprising the recombinant DNA, for example multiple plants from 2 to 20 or more transgenic events. Transgenic plants grown from transgenic seeds provided herein demonstrate improved agronomic traits that contribute to increased yield or other traits that provide increased plant value, including, for example, improved seed quality. Of particular interest are plants having increased water use efficiency or drought tolerance, enhanced high temperature or cold tolerance, increased yield, increased nitrogen use efficiency.

Table 1 provides a list of protein-encoding DNA ("genes") as recombinant DNA for production of transgenic plants with enhanced traits, the elements of Table 1 are described by reference to:

"PEP SEQ ID NO" which identifies an amino acid sequence.

"NUC SEQ ID NO" which identifies a DNA sequence.

"Gene ID" which refers to an arbitrary identifier.

"Protein Name" which is a common name for protein encoded by the recombinant DNA.

TABLE 1

| NUC SEQ ID NO | PEP SEQ ID NO | Gene ID | Protein Name |
|---|---|---|---|
| 1 | 2 | TRDX1-1 | Phosphatidylinositol 3- and 4-kinase family-like protein. |
| 3 | 4 | TRDX1-2 | CspC. |
| 5 | 6 | TRDX1-3 | Fatty acid desaturase A. |
| 7 | 8 | TRDX1-4 | *Arabidopsis* probable auxin-induced protein. |
| 9 | 10 | TRDX1-5 | Dihydrolipoamide dehydrogenase. |
| 11 | 12 | TRDX1-6 | Putative zinc finger protein. |
| 13 | 14 | TRDX1-7 | Soy RING finger protein Pzf. |
| 15 | 16 | TRDX1-8 | Acetoin dehydrogenase E2 component (dihydrolipoamide acetyltransferase) with CTP. |
| 17 | 18 | TRDX1-9 | L-glutamine synthetase with CTP. |
| 19 | 20 | TRDX1-10 | ATP-dependent transmembrane transporter, putative. |
| 21 | 22 | TRDX1-11 | NADH: ubiquinone oxidoreductase-like protein. |
| 23 | 24 | TRDX1-12 | Ribosome associated membrane protein RAMP4. |
| 25 | 26 | TRDX1-13 | Putative zinc finger and C2 domain protein. |
| 27 | 28 | TRDX1-14 | |
| 29 | 30 | TRDX1-15 | GMP synthase (glutamine-hydrolyzing). |
| 31 | 32 | TRDX1-16 | Putative iron deficiency protein Ids3. |
| 33 | 34 | TRDX1-17 | Putative serine threonine-protein kinase. |
| 35 | 36 | TRDX1-18 | Nitrate reductase 1, beta (Fe—S) subunit. |
| 37 | 38 | TRDX1-19 | Ania-6a type cyclin. |
| 39 | 40 | TRDX1-20 | Oxygen evolving complex 17 kDa protein precursor. |

TABLE 1-continued

| NUC SEQ ID NO | PEP SEQ ID NO | Gene ID | Protein Name |
|---|---|---|---|
| 41 | 42 | TRDX1-21 | |
| 43 | 44 | TRDX1-22 | 11-beta-hydroxysteroid dehydrogenase-like. |
| 45 | 46 | TRDX1-23 | Fruit protein PKIWI502. |
| 47 | 48 | TRDX1-24 | WD40 domain-containing protein. |
| 49 | 50 | TRDX1-25 | ZW9. |
| 51 | 52 | TRDX1-26 | Probable membrane-associated 30 kDa protein, chloroplast precursor. |
| 53 | 54 | TRDX1-27 | Putative embryo-abundant protein. |
| 55 | 56 | TRDX1-28 | Putative sodium-bile acid cotransporter. |
| 57 | 58 | TRDX1-29 | Mevalonate diphosphate decarboxylase. |
| 59 | 60 | TRDX1-30 | Mitochondrial oxaloacetate transport protein. |
| 61 | 62 | TRDX1-31 | Pyruvate carboxylase 2. |
| 63 | 64 | TRDX1-32 | Aldose 1-epimerase. |
| 65 | 66 | TRDX1-33 | Alpha/beta hydrolase fold. |
| 67 | 68 | TRDX1-34 | |
| 69 | 70 | TRDX1-35 | Putative cytochrome c oxidase subunit. |
| 71 | 72 | TRDX1-36 | RNA recognition motif-containing protein. |
| 73 | 74 | TRDX1-37 | RING finger-like protein. |
| 75 | 76 | TRDX1-38 | Glucose-6-phosphate 1-dehydrogenase. |
| 77 | 78 | TRDX1-39 | Ids4-like protein. |
| 79 | 80 | TRDX1-40 | Alanine: glyoxylate aminotransferase 2 homolog. |
| 81 | 82 | TRDX1-41 | MATE efflux family protein. |
| 83 | 84 | TRDX1-42 | Glucose-6-phosphate 1-dehydrogenase, cytoplasmic isoform. |
| 85 | 86 | TRDX1-43 | |
| 87 | 88 | TRDX1-44 | Branched-chain amino acid transaminase. |
| 89 | 90 | TRDX1-45 | Xyloglucan endotransglycosylase-like protein. |
| 91 | 92 | TRDX1-46 | Gluconokinase. |
| 93 | 94 | TRDX1-47 | Dehydrin Xero2. |
| 95 | 96 | TRDX1-48 | Ferrodoxin precursor. |
| 158 | 159 | TRDX1-49 | Acetoin dehydrogenase E2 component (dihydrolipoamide acetyltransferase). |
| 160 | 161 | TRDX1-50 | L-glutamine synthetase. |

Selection Methods for Transgenic Plants with Enhanced Traits

Within a population of transgenic plants each regenerated from a plant cell with recombinant DNA many plants that survive to fertile transgenic plants that produce seeds and progeny plants will not exhibit an enhanced agronomic trait. Selection from the population is necessary to identify one or more transgenic plants with an enhanced trait. Transgenic plants having enhanced traits are selected from populations of plants regenerated or derived from plant cells transformed as described herein by evaluating the plants in a variety of assays to detect an enhanced trait, for example, increased water use efficiency or drought tolerance, enhanced high temperature or cold tolerance, increased yield, increased nitrogen use efficiency, enhanced seed composition such as enhanced seed protein and enhanced seed oil. These assays can take many forms including, but not limited to, direct screening for the trait in a greenhouse or field trial or by screening for a surrogate trait. Such analyses can be directed to detecting changes in the chemical composition, biomass, physiological property, or morphology of the plant. Changes in chemical compositions such as nutritional composition of grain can be detected by analysis of the seed composition and content of protein, free amino acids, oil, free fatty acids, starch or tocopherols. Changes in chemical compositions can also be detected by analysis of contents in leaves, such as chlorophyll or carotenoid contents. Changes in biomass characteristics can be evaluated on greenhouse or field grown plants and can include plant height, stem diameter, root and shoot dry weights, canopy size; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant to appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green or deleyed senescence, stalk lodging, root lodging, plant health, barreness/prolificacy, green snap, and pest resistance. In addition, phenotypic characteristics of harvested grain can be evaluated, including number of kernels per row on the ear, number of rows of kernels on the ear, kernel abortion, kernel weight, kernel size, kernel density and physical grain quality.

Assays for screening for a desired trait are readily designed by those practicing in the art. The following illustrates screening assays for corn traits using hybrid corn plants. The assays can be adapted for screening other plants such as canola, wheat, cotton and soybean either as hybrids or inbreds.

Transgenic corn plants having increased nitrogen use efficiency can be identified by screening transgenic plants in the field under the same and sufficient amount of nitrogen supply as compared to control plants, where such plants provide higher yield as compared to control plants. Transgenic corn plants having increased nitrogen use efficiency can also be identified by screening transgenic plants in the field under reduced amount of nitrogen supply as compared to control plants, where such plants provide the same or similar yield as compared to control plants.

Transgenic corn plants having increased yield are identified by screening using progenies of the transgenic plants over multiple locations for several years with plants grown under optimal production management practices and maximum weed and pest control. Selection methods can be applied in multiple and diverse geographic locations, for example up to 16 or more locations, over one or more planting seasons, for example at least two planting seasons, to statistically distinguish yield improvement from natural environmental effects.

Transgenic corn plants having increased water use efficiency or drought tolerance are identified by screening plants in an assay where water is withheld for a period to induce stress followed by watering to revive the plants. For example, a selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

Transgenic cotton plants with increased yield and increased water use efficiency are identified by growing under variable water conditions. Specific conditions for cotton include growing a first set of transgenic and control plants under "wet" conditions, for example irrigated in the range of 85 to 100 percent of evapotranspiration to provide leaf water potential of −14 to −18 bars, and growing a second set of transgenic and control plants under "dry" conditions, for example irrigated in the range of 40 to 60 percent of evapotranspiration to provide a leaf water potential of −21 to −25 bars. Pest control, such as weed and insect control is applied equally to both wet and dry treatments as needed. Data gathered during the trial includes weather records throughout the growing season including detailed records of rainfall; soil characterization information; any herbicide or insecticide applications; any gross agronomic differences observed such as leaf morphology, branching habit, leaf color, time to flowering, and fruiting pattern; plant height at various points during the trial; stand density; node and fruit number including node above white flower and node above crack boll measurements; and visual wilt scoring. Cotton boll samples are taken and analyzed for lint fraction and fiber quality. The cotton is harvested at the normal harvest timeframe for the trial area. Increased water use efficiency is indicated by increased yield, improved relative water content, enhanced leaf water potential, increased biomass, enhanced leaf extension rates, and improved fiber parameters.

Although the plant cells and methods of this disclosure can be applied to any plant cell, plant, seed or pollen, for example, any fruit, vegetable, grass, tree or ornamental plant, the various aspects of the disclosure are applied to corn, soybean, cotton, canola, rice, barley, oat, wheat, turf grass, alfalfa, sugar beet, sunflower, quinoa and sugar cane plants.

Example 1

Corn Transformation

This example illustrates transformation methods in producing a transgenic corn plant cell, seed, and plant having altered phenotypes as shown in Tables 3-5, or an enhanced trait, for example, increased water use efficiency or drought tolerance, increased yield, increased nitrogen use efficiency as shown in Tables 8, 9, and 12.

For *Agrobacterium*-mediated transformation of corn embryo cells corn plants were grown in the greenhouse and ears were harvested when the embryos were 1.5 to 2.0 mm in length. Ears were surface-sterilized by spraying or soaking the ears in 80% ethanol, followed by air drying. Immature embryos were isolated from individual kernels on surface-sterilized ears. Shortly after excision, immature maize embryos were inoculated with overnight grown *Agrobacterium* cells, and incubated at room temperature with *Agrobacterium* for 5-20 minutes. Inoculated immature embryos were then co-cultured with *Agrobacterium* for 1 to 3 days at 23° C. in the dark. Co-cultured embryos were transferred to selection media and cultured for approximately two weeks to allow embryogenic callus to develop. Embryogenic calli were transferred to culture medium containing glyphosate and subcultured at about two week intervals. Transformed plant cells were recovered 6 to 8 weeks after initiation of selection.

For *Agrobacterium*-mediated transformation of maize callus immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media. Paromomycin resistant calli are identified about 6-8 weeks after initiation of selection.

To regenerate transgenic corn plants individual transgenic calli resulting from transformation and selection were placed on media to initiate shoot and root development into plantlets. Plantlets were transferred to potting soil for initial growth in a growth chamber at 26° C. followed by a mist bench before transplanting to 5 inch pots where plants were grown to maturity. The regenerated plants were self-fertilized and seeds were harvested for use in one or more methods to select seeds, seedlings or progeny second generation transgenic plants (R2 plants) or hybrids, for example, by selecting transgenic plants exhibiting an enhanced trait as compared to a control plant.

The above process can be repeated to produce multiple events of transgenic corn plants from cells that were transformed with recombinant DNA from the genes identified in Table 1. Progeny transgenic plants and seeds of the transformed plants were screened for the presence and single copy of the inserted gene, and for increased water use efficiency, increased yield, increased nitrogen use efficiency, and altered phenotypes as shown in Tables 3-7. From each group of multiple events of transgenic plants with a specific recombinant DNA from Table 1 the event(s) that showed increased yield, increased water use efficiency, increased nitrogen use efficiency, and altered phenotypes was (were) identified.

Example 2

Soybean Transformation

This example illustrates plant transformation in producing a transgenic soybean plant cell, seed, and plant having altered phenotypes as shown in Tables 6-7, or an enhanced trait, for example, increased water use efficiency or drought tolerance, increased yield, and increased nitrogen use efficiency.

For *Agrobacterium* mediated transformation, soybean seeds were imbibed overnight and the meristem explants excised. Soybean explants were mixed with induced *Agrobacterium* cells containing plasmid DNA with the gene of interest cassette and a plant selectable marker cassette no later than 14 hours from the time of initiation of seed imbibition, and wounded using sonication. Following wounding, explants were placed in co-culture for 2-5 days at which point they were transferred to selection media to allow selection and growth of transgenic shoots. Resistant shoots were harvested in approximately 6-8 weeks and placed into selective rooting media for 2-3 weeks. Shoots producing roots were transferred to the greenhouse and potted in soil. Shoots that remained healthy on selection, but did not produce roots were transferred to non-selective rooting media for an additional two weeks. Roots from any shoots that produced roots off selection were tested for expression of the plant selectable marker before they were transferred to the greenhouse and potted in soil.

The above process can be repeated to produce multiple events of transgenic soybean plants from cells that were transformed with recombinant DNA from the genes identified in Table 1. Progeny transgenic plants and seed of the transformed plant cells were screened for the presence and single copy of the inserted gene, and for increased water use efficiency, increased yield, increased nitrogen use efficiency, and altered phenotypes as shown in Tables 6-7.

Example 3

Cotton Transformation

This example illustrates plant transformation in producing a transgenic cotton plant cell, plant, and seed having an enhanced trait, for example increased water use efficiency, increased yield, and increased nitrogen use efficiency.

Transgenic cotton plants containing each recombinant DNA from the genes identified in Table 1 were obtained by transforming cotton cells using *Agrobacterium*-mediated transformation as described in U.S. Pat. NOs. 7790460 and 7947869.

Progeny transgenic plants and seed of the transformed plant cells were screened for the presence and single copy of the inserted gene, and for increased water use efficiency, increased yield and increased nitrogen use efficiency. From each group of multiple events of transgenic plants with a specific recombinant DNA from Table 1 the event(s) that showed increased yield, increased water use efficiency, and increased nitrogen use efficiency was (were) identified.

Example 4

Canola Transformation

This example illustrates plant transformation in producing the transgenic canola plants of this disclosure and the production and identification of transgenic seed for transgenic canola having increased water use efficiency, increased yield, and increased nitrogen use efficiency.

Tissues from in vitro grown canola seedlings were prepared and inoculated with overnight-grown *Agrobacterium* cells containing plasmid DNA with a gene of interest cassette and a plant selectable marker cassette. Following co-cultivation with *Agrobacterium*, the infected tissues were allowed to grow on selection to promote growth of transgenic shoots, followed by growth of roots from the transgenic shoots. The selected plantlets were then transferred to the greenhouse and potted in soil. Molecular characterizations were performed to confirm the presence of the gene of interest, and its expression in transgenic plants and progenies. Progeny transgenic plants were selected from a population of transgenic canola events under specified growing conditions and were compared with control canola plants.

The above process can be repeated to produce multiple events of transgenic canola plants from cells that were transformed with recombinant DNA from the genes identified in Table 1. Progeny transgenic plants and seed of the transformed plant cells were screened for the presence and single copy of the inserted gene, and for increased water use efficiency, increased yield, and increased nitrogen use efficiency. From each group of multiple events of transgenic plants with a specific recombinant DNA from Table 1 the event(s) that showed increased yield, increased water use efficiency, increased nitrogen use efficiency and altered phenotypes was (were) identified.

Example 5

Identification of Altered Phenotypes in Automated Greenhouse

This example illustrates screening and identification of transgenic plants for altered phenotypes in an automated greenhouse (AGH). The apparatus and the methods for automated phenotypic screening of plants are disclosed in US Patent publication No. US20110135161 (filed on Nov. 10, 2010), which is incorporated by reference herein in its entirety.

Screening and Identification of Transgenic Corn Plants for Altered Phenotypes.

Corn plants were tested in 3 screens in AGH under different conditions including non-stress, nitrogen deficit and water deficit stress conditions. All screens began with a non-stress condition during day 0-5 germination phase, after which the plants were grown for 22 days under screen specific conditions as shown in Table 2.

Water deficit is defined as a specific Volumetric Water Content (VWC) that is lower than the VWC of non-stress plant. For example, a non-stressed plant might be maintained at 55% VWC and water-deficit assay might be defined around 30% VWC as shown in Table 2. Data were collected using visible light and hyperspectral imaging as well as direct measurement of pot weight and amount of water and nutrient applied to individual plants on a daily basis.

Eight parameters were measured for each screen. The visible light color imaging based measurements are: biomass, canopy area and plant height. Biomass (B) is defined as estimated shoot fresh weight (g) of the plant obtained from images acquired from multiple angles of view. Canopy Area (Can) is defined as area of leaf as seen in top-down image ($mm^2$). Plant Height (H) refers to the distance from the top of the pot to the highest point of the plant derived from side image (mm). Anthocyanin score, chlorophyll score and water content score are hyperspectral imaging based parameters. Anthocyanin Score (An) is an estimate of anthocyanin in the leaf canopy obtained from a top-down hyperspectral image. Chlorophyll Score (Chl) is a measurement of chlorophyll in the leaf canopy obtained from a top-down hyperspectral image. Water Content Score (WC) is a measurement of water in the leaf canopy obtained from a top-down hyperspectral image. Water Use Efficiency (WUE) is derived from the grams of plant biomass per liter of water added. Water Applied (WA) is a direct measurement of water added to a pot (pot with no hole) during the course of an experiment.

These physiological screen runs were set up so that tested transgenic lines were compared to a control line. The collected data were analyzed against the control using % delta and certain p-value cutoff. Tables 3-5 are summaries of transgenic corn plants comprising the disclosed recombinant DNA molecules with altered phenotypes under non stress, nitrogen deficit, and water deficit conditions, respectively.

"+" denotes an increase in the tested parameter at p≤0.1; whereas "−" denotes a decrease in the tested parameter at p≤0.1. The numbers in parenthesis show penetrance of the altered phenotypes, where the denominators represent total number of transgenic events tested for a given parameter in a specific screen, and the numerators represent the number of events showing a particular altered phenotype. For example, 13 transgenic plants were screened for anthocyanin score in the non-stress screen for TRDX1-16 and 3 of the 13 tested showed decreased anthocyanin at p≤0.1.

TABLE 2

Description of the 3 AGH screens for corn plants.

| Screen | Description | Germination phase (5 days) | Screen specific phase (22 days) |
|---|---|---|---|
| Non-stress | well watered sufficient nitrogen | 55% VWC water | 55% VWC 8 mM nitrogen |
| Water deficit | limited watered sufficient nitrogen | 55% VWC water | 30% VWC 8 mM nitrogen |
| Nitrogen deficit | well watered low nitrogen | 55% VWC water | 55% VWC 2 mM nitrogen |

TABLE 3

Summary of transgenic corn plants with altered phenotypes in AGH non-stress screens.

| Gene_ID | Non-Stress | | | | | | | |
|---|---|---|---|---|---|---|---|---|
|  | An | B | Can | Chl | H | WA | WC | WUE |
| TRDX1-9 |  |  |  | +(2/5) |  | −(2/5) |  |  |
| TRDX1-10 (Construct 645) |  |  |  | −(2/5) |  | +(3/5) |  |  |
| TRDX1-16 |  |  |  | +(4/5) |  |  |  |  |
| TRDX1-17 | +(2/5) |  |  |  | +(2/5) | +(4/5) | −(4/5) |  |
| TRDX1-18 |  |  |  |  |  | −(3/4) |  |  |
| TRDX1-19 |  |  |  | +(2/5) |  |  |  | −(2/5) |
| TRDX1-20 |  | −(3/5) | −(2/5) |  |  | −(2/5) |  | −(3/5) |
| TRDX1-23 |  |  |  |  | −(2/5) |  | −(2/5) |  |
| TRDX1-28 |  |  |  |  |  |  |  | −(2/5) |
| TRDX1-31 | +(2/5) |  |  | +(3/5) |  |  |  |  |
| TRDX1-41 |  |  |  |  |  |  |  | −(2/5) |
| TRDX1-48 |  | +(3/5) |  |  |  | +(3/5) |  |  |

TABLE 4

Summary of transgenic corn plants with altered phenotypes in AGH nitrogen-deficit screens

| Gene_ID | Nitrogen Deficit | | | | | | | |
|---|---|---|---|---|---|---|---|---|
|  | An | B | Can | Chl | H | WA | WC | WUE |
| TRDX1-9 |  | −(4/5) | −(2/5) | −(2/5) | −(2/5) | −(4/5) |  | −(2/5) |
| TRDX1-10 (Construct-021) |  | +(2/5) |  |  |  | +(2/5) |  |  |
| TRDX1-10 (Construct-645) |  |  |  | −(2/5) | −(2/5) | −(2/5) |  |  |
| TRDX1-12 |  | −(4/5) | −(3/5) |  | −(3/5) | −(3/5) |  | −(4/5) |
| TRDX1-16 |  | −(2/5) | −(2/5) |  |  | −(4/5) |  | −(2/5) |
| TRDX1-17 | +(2/5) |  |  | −(3/5) |  | −(2/5) | −(2/5) |  |
| TRDX1-18 |  |  |  | +(3/5) |  | +(2/5) | +(2/5) |  |
| TRDX1-19 |  |  |  | +(3/5) |  |  |  |  |
| TRDX1-20 |  | +(2/5) |  | +(3/5) |  | +(2/5) |  | +(2/5) |
| TRDX1-23 |  | −(3/5) | −(2/5) |  | −(5/5) | −(5/5) |  | −(2/5) |
| TRDX1-25 |  | −(3/5) |  |  | −(4/5) | −(4/5) |  |  |
| TRDX1-28 |  |  |  |  |  | +(2/5) |  |  |
| TRDX1-31 | −(2/5) | +(4/5) |  | +(2/5) | +(4/5) | +(3/5) | −(2/5) | +(4/5) |
| TRDX1-33 | −(2/5) |  |  | −(3/5) |  | −(4/5) | −(2/5) | +(2/5) |
| TRDX1-34 |  |  |  |  |  | −(5/5) |  |  |
| TRDX1-36 |  |  |  | +(2/4) | −(2/5) |  |  |  |
| TRDX1-37 |  | −(3/8) | −(5/8) | +(4/7) | −(3/8) |  |  | −(3/8) |
| TRDX1-39 |  |  |  |  |  | +(2/5) |  |  |
| TRDX1-40 | +(3/5) |  |  |  |  | −(3/5) |  |  |
| TRDX1-41 |  |  | −(2/5) | −(2/5) | −(2/5) | −(3/5) |  |  |
| TRDX1-43 | +(2/5) | −(2/5) |  | −(2/5) |  | −(5/5) | +(2/5) |  |
| TRDX1-44 |  |  | −(2/5) | +(2/5) |  |  |  |  |
| TRDX1-45 |  |  |  |  | −(2/5) | +(3/5) |  |  |
| TRDX1-48 |  | +(2/5) |  | −(2/5) |  |  |  | +(2/5) |

TABLE 5

Summary of transgenic corn plants with altered phenotypes in AGH water-deficit screens

| Gene_ID | An | B | Can | Chl | H | WA | WC | WUE |
|---|---|---|---|---|---|---|---|---|
| TRDX1-10 (Construct-021) | | | | | | +(4/5) | | |
| TRDX1-10 (Construct-645) | | | | | | +(2/5) | | -(2/5) |
| TRDX1-12 | | -(2/5) | -(2/5) | | -(2/5) | -(3/5) | | |
| TRDX1-17 | -(4/5) | +(3/5) | -(2/5) | | | -(2/5) | | +(3/5) |
| TRDX1-19 | | | | | | +(4/5) | +(2/5) | |
| TRDX1-20 | | | | | -(2/5) | +(2/5) | | |
| TRDX1-23 | -(2/5) | | | +(3/5) | | | | |
| TRDX1-25 | | -(2/5) | | -(2/5) | | | | -(2/5) |
| TRDX1-31 | | | -(2/5) | -(2/5) | -(2/5) | | | |
| TRDX1-33 | +(2/5) | | +(2/5) | -(2/5) | +(2/5) | | | |
| TRDX1-35 | +(4/5) | | | +(3/5) | | +(5/5) | | |
| TRDX1-36 | | | | | | +(3/5) | | |
| TRDX1-37 | | | | | | +(6/8) | | |
| TRDX1-39 | | +(3/5) | +(2/5) | | +(2/5) | +(4/5) | | |
| TRDX1-40 | -(4/5) | -(4/5) | -(4/5) | | -(4/5) | -(5/5) | | -(3/5) |
| TRDX1-41 | | | -(2/5) | -(2/5) | | | -(2/5) | |
| TRDX1-42 | -(3/5) | | | | | +(2/5) | -(3/5) | |
| TRDX1-43 | | | | | -(2/5) | -(3/5) | | |
| TRDX1-44 | | | +(3/5) | | | +(5/5) | | |
| TRDX1-46 | | +(2/5) | | | +(3/5) | | | +(2/5) |
| TRDX1-48 | | | | | | +(3/5) | | |

Screening and Identification of Transgenic Soybean Plants for Altered Phenotypes.

Soybean plants were tested in 2 screens in AGH under non-stress and water deficit stress conditions. For non-stress screen, the plants were kept under constant VWC of 55% throughout the screen length of 27 days. For water deficit screen, the VWC was kept at 55% for the first 12 days after sowing, followed by gradual dry down at a rate of 0.025 VWC per day, followed by water recovery to 55% VWC at 25 days after sowing.

Water deficit is defined as a specific Volumetric Water Content (VWC) that is lower than the VWC of non-stress plant. For example, a non-stressed plant might be maintained at 55% VWC and water-deficit assay might be defined around 30% VWC as shown in Table 2. Data were collected using visible light and hyperspectral imaging as well as direct measurement of pot weight and amount of water and nutrient applied to individual plants on a daily basis.

Eight parameters were measured for each screen. The visible light color imaging based measurements are: biomass, canopy area and plant height. Biomass (B) is defined as estimated shoot fresh weight (g) of the plant obtained from images acquired from multiple angles of view. Canopy Area (Can) is defined as area of leaf as seen in top-down image (mm$^2$). Plant Height (H) refers to the distance from the top of the pot to the highest point of the plant derived from side image (mm).—Chlorophyll score—is a hyperspectral imaging based parameter. Chlorophyll Score (Chl) is a measurement of chlorophyll in the leaf canopy obtained from a top-down hyperspectral image. Water Use Efficiency (WUE) is derived from the grams of plant biomass per liter of water added. Water Applied (WA) is a direct measurement of water added to a pot (pot with no hole) during the course of an experiment.

These physiological screen runs were set up so that tested transgenic lines were compared to a control line. The collected data were analyzed against the control using % delta and/or certain p-value cutoff. Tables 6-7 are summaries of transgenic soybean plants comprising the disclosed recombinant DNA molecules with altered phenotypes.

TABLE 6

Summary of transgenic soybean plants with altered phenotypes in AGH non-stress screens.

| | Non-stress | | | | | |
|---|---|---|---|---|---|---|
| Gene_ID | B | Can | Chl | H | WA | WUE |
| TRDX1-7 | | | +(2/5) | | -(2/5) | -(2/5) |
| TRDX1-13 | -(2/5) | | | | | -(2/5) |
| TRDX1-14 | | | +(2/5) | | -(2/5) | +(4/5) |

TABLE 7

Summary of transgenic soybean plants with altered phenotypes in AGH water deficit screens.

| | Water deficit | | | | | |
|---|---|---|---|---|---|---|
| Gene_ID | B | Can | Chl | H | WA | WUE |
| TRDX1-7 | -(3/5) | -(2/5) | +(2/5) | +(2/5) | -(2/5) | -(2/5) |
| TRDX1-13 | -(2/5) | -(3/5) | -(3/5) | | -(2/5) | -(2/5) |
| TRDX1-14 | -(2/5) | -(3/5) | -(3/5) | | | -(2/5) |

"+" denotes an increase in the tested parameter at $p \leq 0.1$; whereas "−" denotes a decrease in the tested parameter at $p \leq 0.1$. The numbers in parenthesis show penetrance of the altered phenotypes, where the denominators represent total number of transgenic plants tested for a given parameter in a specific screen, and the numerators represent the number of transgenic plants showing a particular phenotype. For example, 5 transgenic plants were screened for biomass in the non-stress screen for TRDX1-14. Of the 5 tested, 3 showed an increase in biomass at $p \leq 0.1$.

Example 6

Phenotypic Evaluation of Transgenic Plants for Increased Nitrogen Use Efficiency Corn Nitrogen field efficacy trials were conducted to identify genes that can improve nitrogen use efficiency under nitrogen limiting conditions leading to increased yield performance as compared to non transgenic controls. A yield increase in corn can be manifested as one or more of the following: an increase in the number of ears per plant, an increase in the number of rows, number of kernels per row, kernel weight, thousand kernel weight, fresh or dry ear length/diameter/biomass (weight), increase in the seed filling rate (which is the number of filled seeds divided by the total number of seeds and multiplied by 100), among others. For the Nitrogen field trial results shown in Table 8, each field was planted under nitrogen limiting condition (60 lbs/acre) and the corn ear weight or yield was compared to control plants to measure the yield increases.

Table 8 provides a list of protein encoding DNA or polynucleotide sequences ("genes") for producing transgenic corn plant with increased nitrogen use efficiency as compared to a control plant. Polynucleotide sequences in constructs with at least one event showing significant yield or ear weight increase across multiple locations at p≤0.2 are included. The elements of Table 8 are described by reference to:

"SEQ ID NO: polynucleotide" which identifies a nucleotide sequence from SEQ ID NO: 23, 35, 37, 45, 57, 61, 64, 67, 71, 73, 81, 87, or 89.

"SEQ ID NO: polypeptide" which identifies an amino acid sequence from SEQ ID NO: 24, 36, 38, 46, 58, 62, 64, 68, 72, 74, 82, 88, or 90.

"Gene identifier" which refers to an arbitrary identifier.

"NUE results" which refers to the sequence in a construct with at least one event showing significant yield increase at p≤0.2 across locations. The first number refers to the number of events with significant yield or ear weight increase, whereas the second number refers to the total number of events tested for each sequence in the construct.

Example 7

Phenotypic Evaluation of Transgenic Plants for Increased Yield

This example illustrates selection and identification of transgenic plants for increased yield in both dicotyledonous and monocotyledonous plants with primary examples presented for corn, soybean, and canola in Table 9, 10 and 11 respectively. Polynucleotide sequences in constructs with at least one event that resulted in significant yield increase across locations at p≤0.2 are included.

Selection of Transgenic Plants with Enhanced Agronomic Trait(s): Increased Yield.

Effective selection of increased and/or enhanced yielding transgenic plants uses hybrid progenies of the transgenic plants for corn, cotton, and canola, or inbred progenies of transgenic plants for soybean plants plant such as corn, cotton, canola, or inbred plant such as soy, canola and cotton over multiple locations with plants grown under optimal production management practices. An exemplary target for improved yield is a 2% to 10% increase in yield as compared to yield produced by plants grown from seed of a control plant. Selection methods can be applied in multiple and diverse geographic locations, for example up to 16 or more locations, over one or more planting seasons, for example at least two planting seasons, to statistically distinguish yield improvement from natural environmental effects.

Increased Yield in Corn

Table 9 provides a list of protein encoding DNA or polynucleotide sequences ("genes") in the production of transgenic corn plants with increased yield as compared to a control plant. The elements of Table 9 are described by reference to:

"SEQ ID NO: polynucleotide" which identifies a nucleotide sequence.

"SEQ ID NO: polypeptide" which identifies an amino acid sequence.

"Gene identifier" which refers to an arbitrary identifier.

"Broad acre yield results" refers to the sequence in a construct with at least one event showing significant yield

TABLE 8

Recombinant DNA for increased nitrogen use efficiency in corn

| SEQ ID NO: polynucleotide | SEQ ID NO: polypeptide | Gene Identifier | NUE Results | | |
|---|---|---|---|---|---|
| 23 | 24 | TRDX1-12 | 1/5 (Year-1: dry ear weight) | 1/6 (Year-2: yield) | |
| 35 | 36 | TRDX1-18 | 1/8 (Year-1: dry ear weight) | 0/5 (Year-2: fresh ear weight) | 1/8 (Year-3: yield) |
| 37 | 38 | TRDX1-19 | 1/5 (fresh ear weight) | | |
| 45 | 46 | TRDX1-23 | 2/5 (fresh ear weight) | | |
| 57 | 58 | TRDX1-29 | 1/5 (fresh ear weight) | | |
| 61 | 62 | TRDX1-31 | 1/5 (fresh ear weight) | | |
| 63 | 64 | TRDX1-32 | 1/5 (fresh ear weight) | | |
| 67 | 68 | TRDX1-34 | 1/5 (fresh ear weight) | | |
| 71 | 72 | TRDX1-36 | 2/5 (fresh ear weight) | | |
| 73 | 74 | TRDX1-37 | 1/5 (fresh ear weight) | | |
| 81 | 82 | TRDX1-41 | 1/5 (fresh ear weight) | | |
| 87 | 88 | TRDX1-44 | 3/5 (Year-1: fresh ear weight) | 2/7 (Year-2: yield) | 2/4 (Year-3: fresh ear weight) |
| 89 | 90 | TRDX1-45 | 2/5 (fresh ear weight) | | | increase at p≤0.2 across locations. The first number refers to the number of events with significant yield increase, whereas the second number refers to the total number of events tested for each sequence in a construct. As indicated in Table 9, gene TRDX1-10 was tested in two constructs and 2 significantly positive events were identified in one construct, whereas 1 significantly positive event was identified in the second construct.

TABLE 9

Recombinant DNA for increased yield in corn

| SEQ ID NO: polynucleotide | SEQ ID NO: polypeptide | Gene Identifier | Broad Acre Yield Results | | |
|---|---|---|---|---|---|
| 1 | 2 | TRDX1-1 | 1/10 (Year-1) | 1/3 (Year-2) | 2/3 (Year-3) |
| 3 | 4 | TRDX1-2 | 6/10 (Year-1) | 2/7 (Year-2) | 1/6 (Year-3) |
| 11 | 12 | TRDX1-6 | 1/5 (Year-1) | 1/2 (Year-2) | |
| 17 | 18 | TRDX1-9 | 4/10 | | |
| 19 | 20 | TRDX1-10 | Construct-021: 2/8 Construct-645: 1/8 | | |
| 21 | 22 | TRDX1-11 | 1/7 (Year-1) | 1/2 (Year-2) | 3/4 (Year-3) |
| 23 | 24 | TRDX1-12 | 4/8 | | |
| 31 | 32 | TRDX1-16 | 1/8 | | |
| 33 | 34 | TRDX1-17 | 3/8 | | |
| 37 | 38 | TRDX1-19 | 4/8 | | |
| 39 | 40 | TRDX1-20 | 1/8 | | |
| 41 | 42 | TRDX1-21 | 1/8 | | |
| 45 | 46 | TRDX1-23 | 1/8 | | |
| 47 | 48 | TRDX1-24 | 2/8 | | |
| 49 | 50 | TRDX1-25 | 1/8 | | |
| 53 | 54 | TRDX1-27 | 1/8 | | |
| 55 | 56 | TRDX1-28 | 2/8 | | |
| 57 | 58 | TRDX1-29 | 2/7 | | |
| 59 | 60 | TRDX1-30 | 3/8 | | |
| 61 | 62 | TRDX1-31 | 1/8 | | |
| 63 | 64 | TRDX1-32 | 4/8 | | |
| 65 | 66 | TRDX1-33 | 2/8 (Year-1) | 1/8 (Year-2) | |
| 67 | 68 | TRDX1-34 | 2/8 | | |
| 69 | 70 | TRDX1-35 | 3/8 | | |
| 71 | 72 | TRDX1-36 | 1/8 | | |
| 73 | 74 | TRDX1-37 | 3/8 | | |
| 77 | 78 | TRDX1-39 | 2/8 | | |
| 79 | 80 | TRDX1-40 | 1/8 | | |
| 81 | 82 | TRDX1-41 | 1/8 | | |
| 83 | 84 | TRDX1-42 | 1/8 | | |
| 85 | 86 | TRDX1-43 | 2/8 (Year-1) | 1/7 (Year-2) | |
| 87 | 88 | TRDX1-44 | 1/8 | | |
| 89 | 90 | TRDX1-45 | 1/5 | | |
| 91 | 92 | TRDX1-46 | 1/8 (Year-1) | 2/8 (Year-2) | |
| 93 | 94 | TRDX1-47 | 1/8 | | |
| 95 | 96 | TRDX1-48 | 1/8 | | |

Increased Yield in Soybean

A yield increase in soybean can be manifested as one or more of the following: an increase in pods per plant, pods per acre, seeds per plant, seeds per pod, weight per seed, weight per pod, pods per node, number of nodes, and the number of internodes per plant.

Table 10 provides a list of protein encoding DNA or polynucleotide sequences used ("genes") in the production of transgenic soybean plants with increased yield as compared to a control plant. The elements of Table 10 are described by reference to:

"SEQ ID NO: polynucleotide" which identifies a nucleotide sequence.

"SEQ ID NO: polypeptide" which identifies an amino acid sequence.

"Gene identifier" which refers to an arbitrary identifier.

"Broad acre yield results" which refers to the sequence in a construct with at least one event showing significant yield increase at p≤0.2 across locations. The first number refers to the number of events with significant yield increase, whereas the second number refers to the total number of events tested for each sequence in a construct.

TABLE 10

Recombinant DNA for increased yield in soybean

| SEQ ID NO: polynucleotide | SEQ ID NO: polypeptide | Gene Identifier | Broad Acre Yield Results | |
|---|---|---|---|---|
| 7 | 8 | TRDX1-4 | 1/7 | |
| 15 | 16 | TRDX1-8 | 1/6 | |
| 27 | 28 | TRDX1-14 | 1/6 | |
| 29 | 30 | TRDX1-15 | 1/7 | |
| 41 | 44 | TRDX1-22 | 1/8 (Year-1) | 1/5 (Year-2) |
| 51 | 52 | TRDX1-26 | 1/5 | |
| 75 | 76 | TRDX1-38 | 1/7 | |

Increased Yield in Canola

A yield increase in canola can be manifested as one or more of the following: an increase in pod number, number of pods per plant, number of pods per node, number of internodes, incidence of pod shatter, seeds per silique, seed weight per silique, improved seed, oil, or protein composition.

Table 11 provides a list of protein encoding DNA or polynucleotide sequences used ("genes") in the production of transgenic canola plants with increased yield as compared to a control plant. The elements of Table 11 are described by reference to:

"SEQ ID NO: polynucleotide" which identifies a nucleotide sequence.

"SEQ ID NO: polypeptide" which identifies an amino acid sequence.

"Gene identifier" which refers to an arbitrary identifier.

"Broad acre yield results" which refers to the sequence in a construct with at least one event showing significant yield increase at p≤0.2 across locations. The first number refers to the number of events with significant yield increase, whereas the second number refers to the total number of events tested for each sequence in a construct.

TABLE 11

Recombinant DNA for increased Yield in Canola

| SEQ ID NO: polynucleotide | SEQ ID NO: polypeptide | Gene Identifier | Broad Acre Yield Results | |
|---|---|---|---|---|
| 9 | 10 | TRDX1-5 | 4/8 | |
| 25 | 26 | TRDX1-13 | 2/8 (Year-1) | 1/4 (Year-2) |
| 41 | 44 | TRDX1-22 | 3/8 (Year-1) | 2/4 (Year-2) |

Example 8

Phenotypic Evaluation of Corn for Increased Water Use Efficiency

Corn field trials were conducted to identify genes that can improve water use efficiency under water limiting conditions leading to increased yield performance as compared to non transgenic controls. A yield increase in corn can be manifested as one or more of the following: an increase in the number of ears per plant, an increase in the number of rows, number of kernels per row, kernel weight, thousand kernel weight, fresh or dry ear length/diameter/biomass (weight), increase in the seed filling rate (which is the number of filled seeds divided by the total number of seeds and multiplied by 100), among others. The water use efficiency trials for results shown in Table 12 were conducted under managed water limiting conditions, and the corn ear weight or yield was compared to control plants to measure the yield increases.

Table 12 provides a list of protein encoding DNA or polynucleotide sequences ("genes") for producing transgenic corn plant with increased water use efficiency as compared to a control plant. Polynucleotide sequences in constructs with at least one event showing significant yield or ear weight increase across multiple locations at p≤0.2 are included. The elements of Table 12 are described by reference to:

"SEQ ID NO: polynucleotide" which identifies a nucleotide sequence from SEQ ID NO: 67, 69, 79, and 81.

"SEQ ID NO: polypeptide" which identifies an amino acid sequence from SEQ ID NO: 68, 70, 80, and 82.

"Gene identifier" which refers to an arbitrary identifier.

"WUE results" which refers to the sequence in a construct with at least one event showing significant yield increase at p≤0.2 across locations. The first number refers to the number of events with significant yield or ear weight increase, whereas the second number refers to the total number of events tested for each sequence in the construct

TABLE 12

| SEQ ID NO: polynucleotide | SEQ ID NO: polypeptide | Gene Identifier | WUE Results |
|---|---|---|---|
| 67 | 68 | TRDX1-34 | 1/7 (yield) |
| 69 | 70 | TRDX1-35 | 1/7 (fresh ear weight) |
| 79 | 80 | TRDX1-40 | 1/5 (yield) |
| 81 | 82 | TRDX1-41 | 1/8 (yield) |

Corn water use efficiency

Example 9

Phenotypic Evaluation of Cotton for Increased Water Use Efficiency

Cotton field trials were conducted to identify genes for increased yield under standard field conditions, and for improved water use efficiency under drought stress conditions leading to increased yield performance as compared to non transgenic controls. Before planting, all fields had sufficient water for germination but limited enough to allow soil to dry adequately at the time of stress imposition. Evapotranspiration (ET) was calculated from data provided by a site-specific weather station or the nearest/most accurate available weather station when compared to the trial site. Field trials under standard conditions were managed at 70-80% ET replacement. For trials under drought stress conditions, soil moisture was maintained at 30-40% ET during stressed period. Irrigation frequency depended on the specific site, irrigation method, and soil type. Trial locations under drought conditions were further categorized into mid and high stress groups based on the stress severity. Cotton seed and lint yield were measured to determine yield increases as compared to control plants.

Table 13 provides a list of protein encoding DNA or polynucleotide sequences used ("genes") for producing transgenic cotton plants with increased yield under standard field conditions and under drought stress conditions, as compared to a control plant. The elements of Table 13 are described by reference to:

"SEQ ID NO: polynucleotide" which identifies a nucleotide sequence from SEQ ID NO: 5.

"SEQ ID NO: polypeptide" which identifies an amino acid sequence from SEQ ID NO: 6.

"Gene identifier" which refers to an arbitrary identifier.

"Yield results" which refers to the sequence in a construct with at least one event showing significant yield increase at p≤0.2 across locations under standard field conditions or under drought stress conditions. The first number refers to the number of events with significant yield increase, whereas the second number refers to the total number of events tested for each sequence in a construct. Significant yield increases were observed for both cotton seed and lint yield under standard, low and mid drought stress. Both seed yield and lint yield were measured as lb/acre.

TABLE 13

Cotton water use efficiency

| SEQ ID NO: polynucleotide | SEQ ID NO: polypeptide | Gene Identifier | Yield Results | | |
|---|---|---|---|---|---|
| 5 | 6 | TRDX1-3 | Year-1: | Year-2: | Year-3: |
| | | | Standard field condition: | Standard field condition: | Standard field condition: |
| | | | Seed yield: 1/3 | Seed yield: 2/3 | Seed yield: 3/3 |
| | | | Lint yield: 1/3 | Lint yield: 2/3 | Lint yield: 3/3 |
| | | | Drought stress condition: | Drought stress condition: | Drought stress condition: |
| | | | Mid stress: | Mid stress: | Mid stress: |
| | | | Seed yield: 2/3 | Seed yield: 2/3 | Seed yield: 1/3 |
| | | | Lint yield: 2/3 | Lint yield: 2/3 | Lint yield: 1/3 |
| | | | High stress: | High stress: | High stress: |
| | | | Seed yield: 2/3 | Seed yield: 2/3 | Seed yield: 1/3 |
| | | | Lint yield: 2/3 | Lint yield: 1/3 | Lint yield: 1/3 |

Example 10

Enhancement of Yield Conferred by a Promoter-Protein Coding Sequence Combination This example illustrates an enhancement of yield in transgenic corn plants transformed with a plasmid construct that comprises a specific promoter (the Zea mays Nac promoter) and coding sequence (the E. coli CspC protein coding sequence) in operable linkage. The use of the specific promoter-coding sequence combination resulted in an enhancement of yield in field trials conducted in the Year-1 planting season.

Corn plants were transformed with the plasmid construct, Construct-777. The plasmid construct, Construct-777 contained a right border region from A. tumefaciens, a first transgene cassette which provided an enhancement of yield comprising the Zea mays Nac promoter, (P-Zm.Nac, SEQ ID NO: 154), operably linked 5' to the Zea mays Nac leader (L-Zm.Nac, SEQ ID NO: 155), operably linked 5' to the Zea mays Hsp70 heat shock protein intron (I-Zm.DnaK, SEQ ID NO: 156), operably linked 5' to the coding sequence of the cold shock protein C of Escherichia coli (CspC, SEQ ID NO: 3), operably linked to the 3' untranslated region from the pinII proteinase inhibitor gene (T-St.Pis4, SEQ ID NO: 161) and; a second transgene selection cassette used for selection of transformed plant cells that confers resistance to the herbicide glyphosate, and a left border region from A. tumefaciens. Corn plant tissue was transformed with Construct-777 and allowed to regenerate into whole plants. The resulting $R_0$ generation transgenic plants were selected for single copy insertions and allowed to self-cross, resulting in $R_1$ seed. After analysis of segregation of the $R_1$ plants using methods known in the art, the $R_1$ plants, homozygous for the T-DNA insertion were self-pollinated to produce $R_2$ seed. Following multiple rounds of self-pollination to increase the quantity of seed, the $R_4$ or $R_5$ seeds were grown and the resulting plants were crossed into a corn rootworm resistant background, producing a hybrid tester line.

Seeds from ten separate events were tested in the field for yield as measured in bushels per acre over 26 different field locations within the United States. The average yield of each event was compared to a non-transgenic control line with similar background in 2009. As can be seen in Table 14 below, nine of the ten event lines (Event 2 through Event 10) tested in the Year-1 planting season demonstrated overall yield greater than that of the control lines across the field locations.

In the following growing season of Year-2, a subset of seven of the original 10 events (Events 1, 2, 4, 6, 7, 9 and 10) were tested in a similar manner as Year-1. Two events of the seven tested in the second year demonstrated an increase in yield relative to the non-transgenic controls. Event 7 and Event 9 in Table 14 demonstrated increased yield over control across the field locations in both growing seasons.

TABLE 14

Percentage yield relative to controls of events transformed with Construct-777.

| Event | Control Yield | Event Yield | Percentage Yield Increase over Control | Year |
|---|---|---|---|---|
| Event 1 | 229.1092 | 223.3881 | −2.4971 | Year-1 |
| Event 2 | 229.1092 | 234.5788 | 2.3873 | Year-1 |
| Event 3 | 229.1092 | 234.3894 | 2.3047 | Year-1 |
| Event 4 | 229.1092 | 236.6157 | 3.2764 | Year-1 |
| Event 5 | 229.1092 | 235.833 | 2.9348 | Year-1 |
| Event 6 | 229.1092 | 247.7632 | 8.142 | Year-1 |
| Event 7 | 229.1092 | 246.3352 | 7.5187 | Year-1 |
| Event 8 | 229.1092 | 235.768 | 2.9064 | Year-1 |
| Event 9 | 229.1092 | 232.5025 | 1.4811 | Year-1 |
| Event 10 | 229.1092 | 241.5165 | 5.4155 | Year-1 |
| Event 1 | 198.2252 | 191.9275 | −3.1771 | Year-2 |
| Event 2 | 198.2252 | 178.7591 | −9.8202 | Year-2 |
| Event 4 | 198.2252 | 197.3325 | −0.4503 | Year-2 |
| Event 6 | 198.2252 | 194.0568 | −2.1029 | Year-2 |
| Event 7 | 198.2252 | 208.5593 | 5.2133 | Year-2 |
| Event 9 | 198.2252 | 207.2046 | 4.5299 | Year-2 |
| Event 10 | 198.2252 | 197.3384 | −0.4474 | Year-2 |

Earlier transgenic corn plants, transformed with a similar plasmid as Construct-777, but wherein a high expressing constitutive promoter was operably linked to the coding sequence of the E. coli CspC protein (CspC, SEQ ID NO: 3), resulted in off phenotypes that were not suitable for experimentation. The Zea mays Nac promoter (P-Zm.Nac, SEQ ID NO: 154) and leader (L-Zm.Nac, SEQ ID NO: 155) demonstrates expression in most tissues of the plant when operably linked to the β-glucuronidase (GUS) marker gene coding sequence and shows enhanced expression in the developing seed embryo and endosperm as well as in imbibed seed embryo and endosperm. This enhanced expression in the developing and germinating seed would confer an advantage for those coding sequences that, when expressed in the seed tissues during the seed fill stage and at the beginning stages of growth, provide a yield benefit. The use of the Zea mays Nac promoter and leader operably linked to the coding sequence of the E. coli CspC protein resulted in the production of healthy transgenic plants with events that demonstrated an enhancement of yield in either the Year-1 growing season or both the Year-1 and Year-2 growing seasons.

Example 11

Homolog Identification

This example illustrates the identification of homologs of proteins encoded by the DNA identified in Table 1 which were used to provide transgenic seed and plants having enhanced agronomic traits. From the sequences of the homolog proteins, corresponding homologous DNA sequences can be identified for preparing additional transgenic seeds and plants with enhanced agronomic traits.

An "All Protein Database" was constructed of known protein sequences using a proprietary sequence database and the National Center for Biotechnology Information (NCBI) non-redundant amino acid database (nr.aa). For each organism from which a polynucleotide sequence provided herein was obtained, an "Organism Protein Database" was constructed of known protein sequences of the organism; it is a subset of the All Protein Database based on the NCBI taxonomy ID for the organism.

The All Protein Database was queried using amino acid sequences provided in Table 1 using NCBI "blastp" program with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes of the polynucleotides provided herein, and is referred to as the Core List. Another list was kept for all the hits from each organism, sorted by E-value, and referred to as the Hit List.

The Organism Protein Database was queried using polypeptide sequences provided in Table 1 using NCBI "blastp" program with E-value cutoff of 1e-4. Up to 1000 top hits were kept. A BLAST searchable database was constructed based on these hits, and is referred to as "SubDB". SubDB is queried with each sequence in the Hit List using NCBI "blastp" program with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Homologs with at least 95% identity over 95% of the length of the polypeptide sequences provided in Table 1 are reported below in Table 15 with the SEQ ID NO of the original query sequence and the identified homologs.

Example 12

Identification of Protein Domains and Domain Modules by Pfam Analysis

The amino acid sequences of the encoded proteins showing an enhanced trait were analyzed for Pfam protein domains by using the HMMER software and Pfam databases (version 26.0). SEQ ID NOs: 76 and 84 were identified to comprise the same Pfam domain module G6PD_N::G6PD_C as shown in Table 16. The gathering cutoffs for identifying the G6PD_N and G6PD_C domains, as well as the domain descriptions are also listed in Table 17. Protein sequences with at least 70% identity to one of SEQ ID NO: 76 and 84, and having amino acid sequences comprising the Pfam domain module of G6PD_N::G6PD_C were identified and disclosed herein from SEQ ID NO: 170 to SEQ ID NO: 205. All DNA encoding proteins that comprise the domain module of G6PD_N::G6PD_C by Pfam analysis disclosed herein can be used in recombinant DNA for plant cells of this disclosure, for example, for selecting transgenic plants having enhanced agronomic traits.

TABLE 15

Protein sequences and their homologs

| Polypeptide SEQ ID NO | Homolog SEQ ID NOs |
|---|---|
| 2 | 97 |
| 4 | 98, 99, 100, 101, 102 |
| 8 | 103, 104, 105 |
| 20 | 106 |

TABLE 15-continued

Protein sequences and their homologs

| Polypeptide SEQ ID NO | Homolog SEQ ID NOs |
|---|---|
| 22 | 107 |
| 26 | 108, 109 |
| 28 | 110 |
| 30 | 111 |
| 32 | 112 |
| 34 | 113, 114 |
| 36 | 115, 116, 117, 118 |
| 38 | 119, 120, 121, 122 |
| 42 | 123, 124 |
| 44 | 125 |
| 46 | 126 |
| 52 | 127, 128, 129, 130 |
| 56 | 131, 132 |
| 58 | 133 |
| 62 | 134 |
| 64 | 135 |
| 66 | 136, 137 |
| 68 | 138, 139 |
| 70 | 140 |
| 76 | 141, 142, 143, 144 |
| 80 | 145, 146 |
| 84 | 147 |
| 86 | 148 |
| 88 | 149 |
| 92 | 150, 151, 152 |
| 96 | 153 |
| 158 | 162 |
| 160 | 163, 164, 165, 166, 167, 168, 169 |

TABLE 16

Pfam module annotation

| PEP SEQ ID NO | Gene ID | Pfam domain module | Position |
|---|---|---|---|
| 76 | TRDX1-38 | G6PD_N::G6PD_C | 35-222::224-508 |
| 84 | TRDX1-42 | G6PD_N::G6PD_C | 33-212::214-498 |

TABLE 17

Description of Pfam domains

| Pfam domain name | Accession number | Gathering cutoff | Domain description |
|---|---|---|---|
| G6PD_N | PF00479 | 21.7 | Glucose-6-phosphate dehydrogenase, NAD binding domain |
| G6PD_C | PF02781 | 19.5 | Glucose-6-phosphate dehydrogenase, C-terminal domain |

SEQUENCE LISTING (205 sequences)

SEQ ID NO: 1 - DNA, 1950 bp, Zea mays
  Coding sequence of SEQ ID NO: 2.
atgtccagggatttggactgtcctgttcagacacagatggctgtggcagtcctggaccggagctttagcagcgaatatcctggaggtagcagaattgaggggaggcaactgagctggaagagagtatttgtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcacctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactacttcaagaacatttggggagagcgtgtggcaattgtcaagccaactgatgaggaaccatttgctccaaataatccaaaaggttttgtggggaaagctctgggacagccgggcctgaaaaggtctgtacgggttggggagacaggcttcagagaggttgctgcttacctcctcgactatggtcactttgcaaatgttcctcccaccatgctggtcaagataacacacacaatcttcaatgtgaacgactgtgttggctgcaaaagtaaagtgttctgcaacaaatcagaggctgtgagcaagattgcatcgctgcaggagttcattcctcatgatttcgatgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgttcctttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtcctttcttcccaacgaagccggagttgaagatgacgatgatgacttcacccagttccttatcgacggcgaggatgattatccggatgccttggaaccatcagctttctgcaagtttggtagcatgaaggcaagttctaggaatccactgtccaagctagatgagcgtgacgaggaagacggagacgggaccgaggaggacgacgacgacgacatcttgaccggtgcattgcctcagaggatctcgtctatctccaagctgtcgtcatccatgaaggggcttggcttcattgggaaacccaagccctaccgcacgtgccttcggaagggtaaagcgacaggcagaactaagtacaccggcaaagccagcgagcatcagtccggcagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttt

SEQ ID NO: 2 - protein, 650 aa, Zea mays
  Phosphatidylinositol 3-and 4-kinase family-like protein.
MSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDGEDDYPDALEPSAFCKFGSMKASSRNPLSKLDERDEEDGDGTEEDDDDDILTGALPQRISSISKLSSSMKGLGFIGKPKPYRTCLRKGKATGRTKYTGKASEHQSGSRSANELLPPSASFVKLSDMSPKQWSAFLDKFQELLPGALSARKHAAGVVGQRSMPRLGTSCQF

SEQ ID NO: 3 - DNA, 210 bp, Escherichia coli
  Coding sequence of SEQ ID NO: 4.
atggcaaagattaaaggtcaggttaagtggttcaacgagtctaaaggttttggcttcattactccggctgatggcagcaaagatgtgttcgtacacttctccgctatccagggtaatggcttcaaaactctggctgaaggtcagaacgttgagttcgaaattcaggacggccagaaaggtccggcagctgttaacgtaacagctatctag

SEQ ID NO: 4 - protein, 69 aa, Escherichia coli
  E. coli cspC.
MAKIKGQVKWFNESKGFGFITPADGSKDVFVHFSAIQGNGFKTLAEGQNVEFEIQDGQKGPAAVNVTAI

SEQ ID NO: 5 - DNA, 972 bp, Arabidopsis thaliana
  Coding sequence of SEQ ID NO: 6.
atggctgtatcacttccaaccaagtaccctctacgacctatcaccaacatcccaaaaagccaccgtccctcgcttctccgtgtacgtgtcacctgctctgttactaccaccaagcctcagcctaatcgtgagaagcttctggtagagcaacgcactgtgaatcttcctctgtccaacgaccaatctctgcaatcgaccaagcctcgccctaaccgtgagaagcttgtggttgagcaacgccttgccagccctcctctgtccaatgacccaactttgaaatcgacatggactcaccggttatgggttgcagcgggctgcaccactttgtttgtctctttagctaaatctgtcattggagggtttgattctcatctctgcctcgaaccagctttagccggttatgcagggtacatcttagctgatctaggttccggtgtctaccactgggccattgataactacggtgatgagtcaacacctgtagtaggaacccaaatcgaagcatttcagggtcaccacaagtggccttggacaatcaccagacggcaatttgccaacaatctacacgctctggctcaagtcataaccttcacagttcttccactagaccttgcatttaacgaccctgtgtttcacggctttgtgtgcacatttgcattttgcatattgtttagccagcaattccatgcttgggcacatggaaccaagagcaagcttccacctctcgtggtcgcgttgcaggacatggggttacttgtttcacggagacagcatgcggaacatcatcgagcaccgtataacaacaattactgcatcgtgagtggagcatggaacaatgttctggatgagagtaaggtctttgaggcattggagatggtgttttatttccagcttggggtgagacctaggtcatggagtgagccaaactctgactggatagaagaaaccgaaatctccaacaaccaagcataa

SEQ ID NO: 6 - protein, 323 aa, Arabidopsis thaliana
  Fatty acid desaturase A.
MAVSLPTKYPLRPITNIPKSHRPSLLRVRVTCSVTTTKPQPNREKLLVEQRTVNLPLSNDQSLQSTKPRPNREKLVVEQRLASPPLSNDPTLKSTWTHRLWVAAGCTTLFVSLAKSVIGGFDSHLCLEPALAGYAGYILADLGSGVYHWAIDNYGDESTPVVGTQIEAFQGHHKWPWTITRRQFANNLHALAQVITFTVLPLDLAFNDPVFHGFVCTFAFCILFSQQFHAWAHGTKSKLPPLVVALQDMGLLVSRRQHAEHHRAPYNNNYCIVSGAWNNVLDESKVFEALEMVFYFQLGVRPRSWSEPNSDWIEETEISNNQA

SEQ ID NO: 7 - DNA, 426 bp, Arabidopsis thaliana
  Coding sequence of SEQ ID NO: 8.
atgatgataaacgcaaagaagctcatgaagttggccaagaaatggcaacaaagagcagccctcaagagaaaaagaatttcatttcagagatcaagtattactactagcagccaaacagctgtagaaaagggttgtttcgtggtttacacggctgataagatccgtttttcatttcccttaagttacctaagcaacactattgtccaagagctcttgaaaatatctgaagaagagttcggtctcccgacggaaggaccaatcacattgccattcgattcggcctttttagagtatctcatcaatctgatccaaagacgaatggatgaagatacagaaaaggctctgttattgtcaatctcaagtgctagaagctcttttcaaccacaacaacattgtagtgctactcaacagttgcttgtgttttag

SEQ ID NO: 8 - protein, 141 aa, Arabidopsis thaliana
  Arabidopsis probable auxin-induced protein.
MMINAKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 9 - DNA, 1689 bp, Bacillus halodurans
  Coding sequence of SEQ ID NO: 10.
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacggaagagtacgatctcgtcattttaggtggagggactggtggctacgtagccgccatccgcgccacacaactcgatctaaaagtggcattagtcgaaaaaggaaaattaggtggcacgtgcttacataagggatgcataccgagtaaagcgttgcttcggtcggcagaagtattttcgacggttcagaaagccgatcagtttggcgtgaagattgacggagccgcgttagactttacgagtgtacaaaatcgaaaagaacaaattgtcacgcagcttcatcgcggggtcgaaatgctgatgaaaaaaggaaaaatcgatgtctataaaggccatggacgcattttaggtccatcgattttctcccctacgcctggtacgatctctgttgaaatgaacaacggcgaagacaatatgatgctcattccgcgaaacgtcattattgcaacaggttcctcacctcgcgtcttaccagggatggaaattgacggtgaggctgtcttaacgtctgacgaggcgctgaaaatggagcagttgccgaagtcgatgctcattgttggtggcggcgtgatcggaatcgagtgggcttcgatgctcaatgactttggcgttgacgtgacagtcattgaatacggtccacgaattttaccgaccgaagatgcggatattgcaaaggaagctgagcgtcttttaaaaaagagaggcgttacattcaaaacaaacgcaaaagtgttagcggaaacgttggaaaaaggagataactcggtcgtaattgaggcggaggttggcggtgtgagcgagcgtttcaccgctgaaaaaatgctcgtttccgttggacgaacaccgaacgtgaatgacatcggacttgaaaatacagatattgaagtcattgatggcgccattgcggtaaacgagtggtatcaaacgaaagagtcgcatatttatgcgatcggtgatgtgatcggcgggatgcagcttgcccatgtggcgtctcacgaaggaatccttgcagtcgagcatatgacggatcacaagcctgaaccacttaattacttaacggttgcccggtgtgtttatagccatccagaaatggcaagcatcggactatcagaagcggaggcaaaagagaaaggctacgaagtaaaagtcggaacgtttccgtttcaagcgatcggcaaagcacttgtctatggcgaatctgatggatttgtaaagatcctatctgataagaaaacagatgatctactcggtgttcatatgattgggccccatgtgaccgatatgatttctgaagctgcactagcaaaggttctcgatgcagcccattgggaagtggcccatacgattcatccccacccaacgttatccgaggttgttggtgaagcggcattagccgttgacggaaaggcgattcatttttag

SEQ ID NO: 10 - protein, 562 aa, Bacillus halodurans
  Dihydrolipoamide dehydrogenase.
MASSMLSSATMVASPAQATMVAPFNGLKSSAAFPATRKANNDITSITSNGGRVNCMQVWPPIGKKKFETLSYLPDLTDSGGRVNCMQAMTEEYDLVILGGGTGGYVAAIRATQLDLKVALVEKGKLGGTCLHKGCIPSKALLRSAEVFSTVQKADQFGVKIDGAALDFTSVQNRKEQIVTQLHRGVEMLMKKGKIDVYKGHGRILGPSIFSPTPGTISVEMNNGEDNMMLIPRNVIIATGSSPRVLPGMEIDGEAVLTSDEALKMEQLPKSMLIVGGGVIGIEWASMLNDFGVDVTVIEYGPRILPTEDADIAKEAERLLKKRGVTFKTNAKVLAETLEKGDNSVVIEAEVGGVSERFTAEKMLVSVGRTPNVNDIGLENTDIEVIDGAIAVNEWYQTKESHIYAIGDVIGGMQLAHVASHEGILAVEHMTDHKPEPLNYLTVARCVYSHPEMASIGLSEAEAKEKGYEVKVGTFPFQAIGKALVYGESDGFVKILSDKKTDDLLGVHMIGPHVTDMISEAALAKVLDAAHWEVAHTIHPHPTLSEVVGEAALAVDGKAIHF

SEQ ID NO: 11 - DNA, 492 bp, Arabidopsis thaliana
  Coding sequence of SEQ ID NO: 12.
atggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttag

SEQ ID NO: 12 - protein, 163 aa, Arabidopsis thaliana
  Putative zinc finger protein.
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 13 - DNA, 1311 bp, Glycine Max
  Coding sequence of SEQ ID NO: 14.
atgttttatgcagtgcctgaaaattatgtacaccagccttctaattctaattatgacagacaagcattttctgctgctgatgggggttttattgatcttacaatgggaaatggacgagggcctcacaagcgaaagagccctggaattcctccagtctgtgaaagaggcagtacaagcagatattccaatgctacaaatgcagctgatcgtcctacatcttcagaattgcagccagagaagcccaatatggattctctatatatgccttgggaccatgttaatatgacacccacatttagaggtagaggcctatctataaggggtgagggtcctttaaggaatgtgaggagccgttctgcacttgatttggaatccaacctggctaggacccatttatcaaatactcatccacacaactcatactctactggtctaccaattgaccattctaacatggtcgatctttcaactcaaacttctggcactttgaccagggattggagcccaatgagtatatgtcctcctcatggaagggtgtcatcatcagatgcaaatgcttttaatcacgaggcaagtcatttccttattggaagcagttctagtaatgctcctgtagatgttggaggttttcataatgaatttggaactagtagaaatcctactgctcctcaaagttttcataataatctgactcaaactgcaagaggagttcacagtaactactctcaaagatccactccaacttttagggcttcttctagcttacgtttgggacgtgtggcaccttctgatgatggattgcatatggtgtccgaaagttactcttctagacagccaaggccattgaccaccgttggctggcagaacaataatagaaatggaagatcaagaatacctagtgacagatatcggtcattggatgatgagggtttcatgattgttgatcgcacttcactgtatggacctaggaatatgcttgatcgacatagagacatgaggatggacatagacaacatgagttatgaggaactacttgcacttggagagagaataggccatgtgagcacaggattgtctgaggatttgatttccaagtatttgacagaaacaatatactgttcatctgagcaaagtcaagaagaagcttgtgcaatctgcctggaagaatacaagaacatggacgatgtcgggacgctgaaagcttgtggacatgattaccatgtgggttgcattaggaagtggttgtctatgaagaaagtatgtcctatatgcaaagcttctgctttgcctgaggataagaagggcaaatag

SEQ ID NO: 14 - protein, 436 aa, Glycine Max
  Soy RING finger protein Pzf.
MFYAVPENYVHQPSNSNYDRQAFSAADGGFIDLTMGNGRGPHKRKSPGIPPVCERGSTSRYSNATNAADRPTSSELQPEKPNMDSLYMPWDHVNMTPTFRGRGLSIRGEGPLRNVRSRSALDLESNLARTHLSNTHPHNSYSTGLPIDHSNMVDLSTQTSGTLTRDWSPMSICPPHGRVSSSDANAFNHEASHFLIGSSSSNAPVDVGGFHNEFGTSRNPTAPQSFHNNLTQTARGVHSNYSQRSTPTFRASSSLRLGRVAPSDDGLHMVSESYSSRQPRPLTTVGWQNNNRNGRSRIPSDRYRSLDDEGFMIVDRTSLYGPRNMLDRHRDMRMDIDNMSYEELLALGERIGHVSTGLSEDLISKYLTETIYCSSEQSQEEACAICLEEYKNMDDVGTLKACGHDYHVGCIRKWLSMKKVCPICKASALPEDKKGK

SEQ ID NO: 15 - DNA, 1461 bp, Bacillus subtilis
  Coding sequence of SEQ ID NO: 16.
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagctatctgctatatcggggacgccaatgagtcggtgcaggaagaggcgggggcgcctgttgctgaagacaatatgccgcaagccgtccagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaagcaaagcctgtttcggagcagaaagcgcaggaaatcccggtgacaggcatgagaaaggtcatcgctgcccgaatgcaggaaagcctggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatccccatgtgcaccttggtatggctgtagccttggaaaatggcttagtggtgcctgtcatccgccatgctgaaaagctatcgctgattgaactggctcaatccatctcagaaaatgccaaaaaagcacgcgagggacgtgcgggaagcgaagaactgcaaggatctactttctccattacaaaccttggcgcgtttggagttgagcatttcacaccgatactaaatccgccggaaacaggcattctcggcatcggagcaagctatgacacaccggtgtatcaaggggaggagatcgtcagaagcacgatcctgccactcagcctgacatttgatcacagagcgtgtgacggcgcccctgccgctgcattcctgaaggcgatgaaaacatatttggaagaacccgcagcattaattttatag

SEQ ID NO: 16 - protein, 486 aa, Bacillus subtilis
  Aacetoin dehydrogenase E2 component (dihydrolipoamide acetyltransferase)with CTP.
MASSMLSSATMVASPAQATMVAPFNGLKSSAAFPATRKANNDITSITSNGGRVNCMQVWPPIGKKKFETLSYLPDLTDSGGRVNCMQAMAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 17 - DNA, 1641 bp, Pseudomonas fluorescens
  Coding sequence of SEQ ID NO: 18.
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgacggtacccccgcgtgccgttcagcttaacgaagcgaacgcgttccttaaggaacatcctgaggttctgtacgttgaccttctgattgcggatatgaatggtgtggtgcgcggcaagcgcatcgaacgcaccagcctccacaaggtttacgagaaaggcatcaacctgccggcctctctatttgctctggatatcaatggttcgacggtggaaagcaccggcctgggcctggacatcggcgacgccgaccgtatctgctatccaatccccgataccctgtgcaacgagccatggcagaagcgcccgaccgcgcaactgttgatgaccatgcacgaactcgaaggtgaccctttcttcgccgacccgcgcgaagtgctccgtcaagttgttgcaaagtttgacgagcttggcttgaccatctgcgccgcgttcgaactcgagttttacctgatcgaccaggaaaacgtgaacggccgccctcagccgccacgctcgccgatctccggcaaacgcccgcattcgactcaggtttacctgatcgacgacctcgacgaatacgtcgactgcctccaggacattctggaaggcgccaaagagcaaggtattccggccgacgccatcgtcaaggaaagtgccccggcgcagttcgaagtgaacctgcaccacgtcgccgacccgatcaaggcatgcgactacgcggtcctgctcaagcgtctgatcaagaacatcgcctacgaccatgaaatggacaccactttcatggccaagccgtacccgggccaggcaggcaacggtctgcacgtccacatttcggttctcgacaaagaaggcaaaaacatttttgccagcgaggatcccgagcagaacgccgcgctgcgtcacgcgatcggcggtgtgctcgagaccctgcccgcgcagatggctttcctctgcccgaacgtcaactcctaccgtcgtttcggcgcacagttctacgtgccgaactcgccgagctggggcctggacaaccgcaccgtggccctgcgcgtaccgaccggctccgccgacgcggtccgtctggaacaccgcgttgccggcgccgacgccaacccgtacctgctgatggcttcggtgctggcgggcgtgcaccacggtctgaccaacaagatcgagccaccggctccgaccgaaggcaacagctacgagcagaacgagcagagcctgccgaacaacttgcgcgatgccctgcgcgagctggacgacagcgaggtgatggccaagtacatcgatccgaaatacatcgatatcttcgtcgcctgcaaagagagcgaactggaggagttcgaacactccatctccgacctcgagtacaactggtacctgcacaccgtttag

SEQ ID NO: 18 - protein, 546 aa, Pseudomonas fluorescens
  L-glutamine synthetase with CTP.
MASSMLSSATMVASPAQATMVAPFNGLKSSAAFPATRKANNDITSITSNGGRVNCMQVWPPIGKKKFETLSYLPDLTDSGGRVNCMQAMTVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 19 - DNA, 2064 bp, Arabidopsis thaliana
  Coding sequence of SEQ ID NO: 20.
atggagttagagagtacgagcaatggccgacgtccgccgccaccggcagagattggccgtggggcgtacttggcgtgggaagatttgacggtggttataccaaactttagtggtggtccgactcgaagattgctcgatggattaaacggtcatgctgaaccaggtcggattatggccattatgggtccttccggatccggcaagtccacgcttcttgattctctcgcaggtagactcgcaagaaacgtgattatgaccggtaatcttctattgaacggaaagaaggcaagactagactacggtctcgtcgcttatgtaacacaagaggacattttgatgggaacactaacggtgagggagacaataacatactcagctcatctacggctatcaagtgatttgaccaaagaagaagtcaacgacattgttgaaggaacaatcattgaacttggtcttcaagattgtgcagacagagtcataggtaattggcattctagaggagtgagtggcggcgagaggaaacgcgtcagcgttgcgttagagatcttaacgcgaccgcaaattttgtttcttgatgaacctactagtggtttggacagtgcttctgctttctttgtgattcaagcgctaaggaatatcgctcgagatggtggtagaaccgttgtttcatcgattcatcaacctagtagcgaagtttttgctctctttgatgatctttttttgctctctagtggtgagactgtttattttggtgaatccaagtttgctgttgagttctttgctgaagcggggtttccttgcccgaagaaacggaatccttctgatcatttcctaagatgtatcaactcagactttgataccgttacagctacactcaaaggatctcaaaggattcgggagacaccagctacatcagatcctttgatgaatctagcaacatctgagatcaaagctaggcttgttgagaattatcgtcgttcagtctacgctaaatctgcaaaatctcgcatccgtgaattagctagcattgaaggacatcatgggatggaagtgagaaagggaagcgaagcgacgtggtttaagcagctaagaactttgacaaagagatcatttgtgaacatgtgccgcgatattggatactattggtcaagaattgtgatctatattgtggtatcattctgtgttgggacaatcttttacgatgtaggacatagctacacatcgatcttggctcgggtttcttgtggtggattcattaccggtttcatgactttcatgtccattggagggtttccttctttcattgaagaaatgaaagtgttctataaagagagattgagtggttactacggcgtttcggtttatatcatatcgaattacgtctcttctttcccgttcttggtagccattgcgctcatcacagggagtattacttacaacatggtgaaattccgtcctggtgtctcgcattgggctttcttctgtctcaacatattcttctctgtctccgtcattgagagtctcatgatggttgtggcttctcttgttccgaatttcttgatgggtcttatcacaggagctggcatcattggaatcatcatgatgacttctggattcttccgtttgcttcccgatctgccaaaggttttctggcgctacccgatttccttcatgagttatggttcttgggctattcagggagcatacaagaatgattttcttggtctagagtttgacccgatgtttgcgggggaaccaaagatgacaggagagcaagtgataaacaagatatttggagtgcaagtcacacattctaagtggtgggacttatcagcgatcgtgttgatccttgtgtgttaccgcattctatttttcatagtcttgaagcttaaggagagagcagagccggctttgaaggcgatacaagcaaagcgaacgatgaagagtctcaaaaagagaccttctttcaagaaagttccatctctatcatcactatcttcaaggagacaccaacctctacattcactttcttctcaagaaggtcttacctctccaattaattag

SEQ ID NO: 20 - protein, 687 aa, Arabidopsis thaliana
  ATP-dependent transmembrane transporter, putative [Arabidopsis thaliana].
MELESTSNGRRPPPPAEIGRGAYLAWEDLTVVIPNFSGGPTRRLLDGLNGHAEPGRIMAIMGPSGSGKSTLLDSLAGRLARNVIMTGNLLLNGKKARLDYGLVAYVTQEDILMGTLTVRETITYSAHLRLSSDLTKEEVNDIVEGTIIELGLQDCADRVIGNWHSRGVSGGERKRVSVALEILTRPQILFLDEPTSGLDSASAFFVIQALRNIARDGGRTVVSSIHQPSSEVFALFDDLFLLSSGETVYFGESKFAVEFFAEAGFPCPKKRNPSDHFLRCINSDFDTVTATLKGSQRIRETPATSDPLMNLATSEIKARLVENYRRSVYAKSAKSRIRELASIEGHHGMEVRKGSEATWFKQLRTLTKRSFVNMCRDIGYYWSRIVIYIVVSFCVGTIFYDVGHSYTSILARVSCGGFITGFMTFMSIGGFPSFIEEMKVFYKERLSGYYGVSVYIISNYVSSFPFLVAIALITGSITYNMVKFRPGVSHWAFFCLNIFFSVSVIESLMMVVASLVPNFLMGLITGAGIIGIIMMTSGFFRLLPDLPKVFWRYPISFMSYGSWAIQGAYKNDFLGLEFDPMFAGEPKMTGEQVINKIFGVQVTHSKWWDLSAIVLILVCYRILFFIVLKLKERAEPALKAIQAKRTMKSLKKRPSFKKVPSLSSLSSRRHQPLHSLSSQEGLTSPIN

SEQ ID NO: 21 - DNA, 327 bp, Arabidopsis thaliana
  Coding sequence of SEQ ID NO: 22.
atggaggcgaatgcggcggtggacggaacggggaatccgatccctacgtcggcggttttaacagcttcggcgaagcatataggaatcaggtgtatgccggaaaacatggcgttcctgaaatgtaagaagaatgatcctaacccagagaaatgcctcgagaagggacgtgacgtcactcgctgtgttcttggcctgctgaaggatcttcaccagagatgcccaaaggagatggatgcttacgttggatgcatgtattactacaccaacgagtttgagttgtgtcggaaagagcaagaagcttttgagaaagtgtgtccgttgaaatag

SEQ ID NO: 22 - protein, 108 aa, Arabidopsis thaliana
  NADH:ubiquinone oxidoreductase-like protein.
MEANAAVDGTGNPIPTSAVLTASAKHIGIRCMPENMAFLKCKKNDPNPEKCLEKGRDVTRCVLGLLKDLHQRCPKEMDAYVGCMYYYTNEFELCRKEQEAFEKVCPLK

SEQ ID NO: 23 - DNA, 1641 bp, Zea mays; identical to SEQ ID NO: 17
  Coding sequence of SEQ ID NO: 24.

SEQ ID NO: 24 - protein, 546 aa, Zea mays; identical to SEQ ID NO: 18
  Ribosome associated membrane protein RAMP4

SEQ ID NO: 25 - DNA, 1011 bp, Arabidopsis thaliana
  Coding sequence of SEQ ID NO: 26.
atgagcaattatgcagccggactcggtaagcctggctcaggtaaaaggagaatcagagatcttttaaatcaacctgataaccgagtctgcgctgattgtggcgcttctgatcctaaatgggcatcagcaaatatcggagtattcatttgcttaaaatgttgcggtgtgcacaggagcctcggcactcatatttcaaaggttttgtctgtgacactagatgaatggtcagatgaggaagtcgattccatgattgaaattggaggaaatgcgtctgctaattcaatttatgaagcttttttacctgacacgtgctctaagcctggacctgatgttaatcatgaccagcgtatgagattcattagggcaaaatatgaactgcaagagtttctgaaaccaagcttgcggattacatccgggaaaggctcaacaaagagttcagcttttcttacatcaagtctttctagaaagatcatggatagttttcgcacaaattcatcatcgcagacgatgtttcaggaaggaatggtagagtttattggattgttgaaggtgactattaagaagggaactaacttagcaatcagagacatgatgtcaagtgatccatatgttgtgttgaatctagggaagcaaaaacttcagacaactgttatgaatagtaatttgaacccggtatggaatcaagaactcatgctgtctgttcctgagagctatggccctgtgaaattgcaagtgtatgattatgatacattttctgctgatgacataatgggagaagcagatattgatatacaacctttgataacatctgcaatggcttttggggatccagaaatgtttggggatatgcagattgggaaatggctaaaatcgcatgataacccattaatagatgacagtatcattaacattgttgatgggaaagtgaaacaggaggttcagatcaagcttcagaatgtagagtctggagaattagagctagaaatggaatggctgccacttgaccaatag

SEQ ID NO: 26 - protein, 336 aa, Arabidopsis thaliana
  Putative zinc finger and C2 domain protein [Arabidopsis thaliana].
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMFQEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 27 - DNA, 351 bp, Arabidopsis thaliana
  Coding sequence of SEQ ID NO: 28.
atggcttcgtctgcgccacagggatctgttgatcctctcaccgggaaagatccggcgaaggctttaaccgctgttgcttctggattcttcgagaatgtgaagaaaaacaagcaaagcttcttccagttcgccgccatgactgggattttgcttctgagtttccgatcggtaagtcagaagtaccgaattcacgatctggaggaagacactgctgttctcaagaaggaacaagatagtttgacggatcgtatgagtaaaatcaaaagcgatcttcttcatcaagcatcgattgactcttccggcgtctttgcttctcgtctccgtctacttttcggtgaagataaaaagtag

SEQ ID NO: 28 - protein, 116 aa, Arabidopsis thaliana
  Hypothetical protein.
MASSAPQGSVDPLTGKDPAKALTAVASGFFENVKKNKQSFFQFAAMTGILLLSFRSVSQKYRIHDLEEDTAVLKKEQDSLTDRMSKIKSDLLHQASIDSSGVFASRLRLLFGEDKK

SEQ ID NO: 29 - DNA, 1623 bp, Nostoc punctiforme
  Coding sequence of SEQ ID NO: 30.
atgaatacagcggtgactctactaaccgaacaagcccctcaaccaatagaagagtttgggcagcttgagcgtcaaatcattatcatattagacttcggctctcagtattcagaactgattgcccgacgcatccgcgagactcaagtatactctgaagttttgtcttatcgcacccctgctgaacatttacgccaactcaatcccaagggaattattctttctggtggccccagttcagtttatagcgatcgcgctccccattgtgacccagaaatctggaatttgggagtccccattttgggtgtctgctacggaatgcagctgatggtcaaccaactcggtggcgaagtagccaaagctgaccggggtgagtatgggaaagcatcattacacattgatgatcccaccgatttactgaccaacgttgaagatggcacaacaatgtggatgagtcatggtgattcagtcacaaaaatgcccccagggtttgaagtgttggcacatacagataatactccctgtgctgctgttgctgaccacgagaaaaagctttatggcgtgcagttccatccagaagtagtccattccgttggtggtttggcattaattcgcaactttgtttatcacatttgtgagtgtgaacccacctggacgacggctgcttttgtggaagaagctattcgggaagtccgggctaaagttggtgacaagcgagtactattggcgctttcgggaggagtcgattcttctaccctggctttcttgatgcacaaagccatcggcgaccaattgacttgtgtatttatcgaccaaggctttatgcggaagtatgagccagaaaggttggtgaaactatttcaggagcagtttcatatccctgttgaatatgttaacgcccgcgatcgcttcttagatatcatgtcaggtgtgacagacccagaagaaaaacgtcgtcgcattggacatgaattcatccaggtatttgaagaaacatctaaaaatctgggcccctttgactatctagcacaagggactctttacccagatgtcattgaatcggctgataccaatgttgacccccaaactggggaacgggtagcggtaaaaatcaaaagccatcacaacgttggcggcttacccaaagacttgagatttaaactagttgaacccctgcggaaactgtttaaagatgaagtccgtaaagtagggcggtctgttggtttaccagaagagattgttcaacgccagccatttcctggccctggtttagctattcggattttgggtgaagtcaccgccgacagattgaacattctccgcgatgctgatttgattgtgcgccaagaaattaaccaacgcggtttatacaatgaatattggcaagcattcgcagttttactacctatccgcagtgtgggcgtaatgggtgatcaacgcacctatgcttatcctatcgtcttacgcattgtcaagagcgaagatggcatgacagcagattgggcgcgtgtaccttacgatgttttagaagcaatttctaaccgcattgtcaacgaagttaaaggcgttaaccgcgtggtgtttgatattacttccaagccacccggaaccattgagtgggaatag

SEQ ID NO: 30 - protein, 540 aa, Nostoc punctiforme
  GMP synthase (glutamine-hydrolyzing) [Nostoc sp. PCC 7120].
MNTAVTLLTEQAPQPIEEFGQLERQIIIILDFGSQYSELIARRIRETQVYSEVLSYRTPAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHEKKLYGVQFHPEVVHSVGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMSGVTDPEEKRRRIGHEFIQVFEETSKNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 31 - DNA, 1041 bp, Zea mays
  Coding sequence of SEQ ID NO: 32.
atggagaatatgctccacctagccccgtcgtcccaggcccaggcattggccttggaccgctcctccgtcttctcgcgtgagcacgtgccgccggccgtctccgctgtcacctccctgccagttatcgacatgtctcgcagccgcgacgaggtccgccgcgctatcctcgacgccggcatggagttcggcttcttcctggtggtggagcacggcatcccagaggaggtgatgcgcgacatgctggaggtgtgcgaggagttcttccagctgccggcggcgagcaaggcgtacatgtactcggaggacagtcagaggcccaaccggatcttctccggcacaacctacgacacgggcggcgacaagtactggcgggactgcctccgcctcgcctgcccctcgtccttcccggtcggcagcggcacaagggacgactggccgcacacgccccagcggctgaggggtgtcgtggagcgtttcaccgctctgacgagagggctgggggtggagctgctgcggctgctgtccgaggccatggggatccggcccgactacttcgagggcgacatcagcgccggcgacgtggtcctcaacgtcaaccactaccctccgtgccccagcccggagaagacgctcggcctgccgccacattgcgaccgcaacctcatcaccctcctcctccaaggctccgtctatggcctcgacgtcgcctacaggggagagtggataaaggtcgagcccatgcccggtgccttcgtcgtcaacttcggccagcaactcgaggtggtgaccaacggattgctgaagagcgttgagcaccgcgtggtgaccagctcgacgctggcgcggacggcggtggccacattcatcatgcccaccccagactgcctcatcggcccgtcaaaggagttcctcgccggggacaagccaccgtgctaccgcaccatcaggttcggtgacttcatgcgcatgtacaacactgtcaagctggggtcatccatcaaccagactacagatcttaagaatgtccagaagaagatatga

SEQ ID NO: 32 - protein, 346 aa, Zea mays
  Putative iron deficiency protein Ids3.
MENMLHLAPSSQAQALALDRSSVFSREHVPPAVSAVTSLPVIDMSRSRDEVRRAILDAGMEFGFFLVVEHGIPEEVMRDMLEVCEEFFQLPAASKAYMYSEDSQRPNRIFSGTTYDTGGDKYWRDCLRLACPSSFPVGSGTRDDWPHTPQRLRGVVERFTALTRGLGVELLRLLSEAMGIRPDYFEGDISAGDVVLNVNHYPPCPSPEKTLGLPPHCDRNLITLLLQGSVYGLDVAYRGEWIKVEPMPGAFVVNFGQQLEVVTNGLLKSVEHRVVTSSTLARTAVATFIMPTPDCLIGPSKEFLAGDKPPCYRTIRFGDFMRMYNTVKLGSSINQTTDLKNVQKKI

SEQ ID NO: 33 - DNA, 1191 bp, Arabidopsis thaliana
  Coding sequence of SEQ ID NO: 34.
atgttttgtgatagttttgcatttgcccaagtgatgagttgcttcgggtgttttggtggctctgagagatcaagacattcaccaaatccatatgatgatgatacatattcccatgatagtggtgaaaccagcaatccgggaggagatgatgaagaaggagaagaggaagaggaagtagaggagctaagtcgttccaaacgatctgaagaaattttgaaatgtaaactacaaaatggactagtctgcaggcagtttccagtcaaggaaactaataaacttacacgcggagaggatgaagatggaaacaagacaataaatgagtttgttcgtgagcgtaaaattggatctggtagttatgggaaagtggttctctatcgaagcactgtcgatgacaagcattatgctattaaggcttttcacaagtcacatttatcgaggctacgggttgcaccttcagaaactgctatgggtgatgttcttcgtgaggttatgattatgaaaaccctggagcatcctaatatcgttaatctcattgaggtgattgatgaccctgagtttgatgatttttacatggttctcgaatatgttgatggaaaatgggcctatgatgattctggaccaccgggtgctctcggagaaattactgctagaaagtacttgcgcgatgtagttgccggcctcatgtaccttcatgctcataatgtaattcatggtgacatcaaacctgacaatttactggttactagtaccgggagagtgaaaataggagatttcagtgtcagccaagtattcaaagatgatgatgatcaactccgtagatcacccggcactcctgtctttactgccccagaatgttgtttaggtataacatacagtggaagatctgcagatacgtgggcagtaggagttactttgtattgtatgattttaggacaatacccatttctgggtgatacacttcaagatacttatgacaagattgttcacaacccgttgataataccggaaggactcaatcctcgtctaagggacttgatcgaaggtctcctttgcaaagatccaaaccagaggatgacgttgaaagctgtggcggagcatccatggatcacaggagaagacggggctatttcggaatactgttgttggtgcaaacgcaaagctgaagaagaagaagatcaaaaccatagctag

SEQ ID NO: 34 - protein, 396 aa, Arabidopsis thaliana
  Putative serine threonine-protein kinase [Arabidopsis thaliana].
MFCDSFAFAQVMSCFGCFGGSERSRHSPNPYDDDTYSHDSGETSNPGGDDEEGEEEEEVEELSRSKRSEEILKCKLQNGLVCRQFPVKETNKLTRGEDEDGNKTINEFVRERKIGSGSYGKVVLYRSTVDDKHYAIKAFHKSHLSRLRVAPSETAMGDVLREVMIMKTLEHPNIVNLIEVIDDPEFDDFYMVLEYVDGKWAYDDSGPPGALGEITARKYLRDVVAGLMYLHAHNVIHGDIKPDNLLVTSTGRVKIGDFSVSQVFKDDDDQLRRSPGTPVFTAPECCLGITYSGRSADTWAVGVTLYCMILGQYPFLGDTLQDTYDKIVHNPLIIPEGLNPRLRDLIEGLLCKDPNQRMTLKAVAEHPWITGEDGAISEYCCWCKRKAEEEEDQNHS

SEQ ID NO: 35 - DNA, 1539 bp, Escherichia coli
  Coding sequence of SEQ ID NO: 36.
atgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatag

SEQ ID NO: 36 - protein, 512 aa, Escherichia coli
  Nitrate reductase 1, beta (Fe-S) subunit [Escherichia coli str. K12 substr. W3110].
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 37 - DNA, 1251 bp, Arabidopsis thaliana
  Coding sequence of SEQ ID NO: 38.
atgatttacactgctatcgacaatttttacctaaccgacgagcagctgaaggcttcaccttcgaggaaagatgggatagatgaaacaactgaaatctctcttagaatctatggatgtgatctcatccaagagggtggaatattgctcaaactaccacaggcagttatggctactgggcaggttctgtttcagcgattctattgcaagaagtctttggctaaatttgatgtcaagatagttgctgccagctgtgtatggcttgcatcaaaactggaagaaaaccctaaaaaagctagacaggtcatcatcgtattccacaggatggagtgtcgcagggagaacttgccattagaacatctggatatgtatgccaagaagttctctgagttgaaagttgaattaagcagaactgagagacatatactgaaagagatgggttttgtttgtcatgttgaacatcctcacaagttcatatcaaactaccttgccacattagaaacacctccagaattgaggcaagaagcttggaatttggccaatgatagtctgcgtacaaccctctgtgtaaggttcagaagtgaggttgtggcttgtggggtagtgtatgctgctgcccgtaggtttcaagtaccactccctgagaatccgccgtggtggaaagcatttgatgcagataaatctagtattgacgaagtgtgtagagttcttgctcatttatacagtcttccaaaggctcagtatatctctgtttgcaaggatgggaagccatttacattttctagcagatccgggaattctcaaggtcaatcagcgacaaaggatctgttgccgggagcaggcgaggctgttgatactaaatgtactgcaggatcagctaataacgacttgaaggatggaatggttactacaccacacgaaaaggctacagattccaagaaaagtggtaccgagtcaaactctcagccaattttaggagactcaagctatgaaagaagtaaagtaggagatagagaaagagagagtgatagagagaaggaacgaggtagagagagggacaggggtaggtctcacagaggcagagattctgacagagacagtgatagggagagagacaaactcaaagatcgaagtcatcatcggtcaagagacagattgaaggattcaggtggacattcagataaatcaaggcatcattcttctcgggaccgtgactaccgcgactcatcgaaagaccgtcgtaggcaccattag

SEQ ID NO: 38 - protein, 416 aa, Arabidopsis thaliana
  Ania-6a type cyclin [Arabidopsis thaliana].
MIYTAIDNFYLTDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPILGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 39 - DNA, 654 bp, Zea mays
  Coding sequence of SEQ ID NO: 40.
atggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcggcggcgagggtgaagacgtcggcgcaggacatcatcaacctcaagccgctcatcgacaagaaggcgtggccgtacgtccagaacgacctccgcctccgggcctcctacctgcgctacgacctcaagaccgtcatcgcttccaagcccaaggaggagaagaagagcctcaaggagctcaccggcaagctcttcagcaccatcgacgatcttgaccatgccgcgaagatcaagagcaccccagaggccgagaaatacttcgcagcaaccaaagatgctcttggcgatgttctcgccaagctaggctag

SEQ ID NO: 40 - protein, 217 aa, Zea mays
  Oxygen evolving complex 17 kDa protein precursor [Zea mays].
MAQAMASMTGLSQGVLPSRRADSRTRTAVVIVRASAEGDAVAQAGRRAVIGLVATGIVGGALSQAARAETVKTIKIGAPPPPSGGLPGTLNSDQARDFDLPLKERFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDALGDVLAKLG

SEQ ID NO: 41 - DNA, 921 bp, Physcomitrella patens
  Coding sequence of SEQ ID NO: 42.
atggccgcgtcggcagcttccactgctctcaccgtgtccgggtccactagcctggacatgtccacgttgtccagcaagtccgccttcggcagcagctgcagtgcgatgcaggcggccccagtgagtaggcgcgccgtccgctcgggcgtcgtcatggccagcgtcgggtccgaggaggccaagcctgcgaggcgcgaggtgctggccggcatcttggccgcgggagcggcgctgggattctcgggtcaggcgaacgctgcaatgaacccagtggccgcagccaagagcaaggcgggtcaggcagtgcagggcgccaaggacctggcgggaagcaaccctctggagggcgtggttggctcgaaccccctgggtgacgcgcagagcacggtggaggaggcggcgtcgggcatcaagggccgcatcgacggactgttcggcaaggacaagccgtacccgaagaggaacacgcaggtgacgggcaagggccccgtcgcggacgccaaggcacgagtgggcaacttcctggacaactcgcagaacccgttggccaccaacatcgagaaggcagcgaaggaggcggagtccggtctggctgtagcgacggggcccaactccccgagcgcacgagcgggcaaggagtttctgggacaagacagcacgcgcgtggacgaggcgactgtcagggtgaacgcgggcgcggagaagctgcagggcaaggccgtgcaggcggtggatgatgtgaagagcgcagtgggcgctgccaaggacgccgcaccggatgtgaaggtggaggcgcctgggtccgggttgctgaagtcgttcgggagcaaggtggacgctgtgaaggggaatgtcgcctccatggcggaggacgccaagagcactgccggcggcgctgcgtccaacgtgctcggccagtag

SEQ ID NO: 42 - protein, 306 aa, Physcomitrella patens
  Predicted protein [Physcomitrella patens subsp. patens].
MAASAASTALTVSGSTSLDMSTLSSKSAFGSSCSAMQAAPVSRRAVRSGVVMASVGSEEAKPARREVLAGILAAGAALGFSGQANAAMNPVAAAKSKAGQAVQGAKDLAGSNPLEGVVGSNPLGDAQSTVEEAASGIKGRIDGLFGKDKPYPKRNTQVTGKGPVADAKARVGNFLDNSQNPLATNIEKAAKEAESGLAVATGPNSPSARAGKEFLGQDSTRVDEATVRVNAGAEKLQGKAVQAVDDVKSAVGAAKDAAPDVKVEAPGSGLLKSFGSKVDAVKGNVASMAEDAKSTAGGAASNVLGQ

SEQ ID NO: 43 - DNA, 1050 bp, Arabidopsis thaliana
  Coding sequence of SEQ ID NO: 44.
atggagttgataaacgactttctcaacctaactgctcctttcttcaccttctttggtctctgcttcttcttgcctcctttttacttcttcaagttcttgcagtctattttctcgacaattttctctgaaaatctttacgggaaagttgttctcatcactggtgcttcctccggtataggcgagcaattggcatatgagtacgcatgtagaggtgcatgtttagccctgaccgcccgaaggaagaaccgtctagaggaagtggcagagattgctcgtgaactcggatctcccaatgttgttaccgttcatgctgatgtctccaaacctgatgactgtagacgaatcgttgatgacaccatcacccattttggcagattggatcatcttgtaaataatgctgggatgacgcagatttcaatgtttgagaacattgaagatataacgaggacaaaagcagttttggatactaacttctggggatcggtttataccactcgtgctgcgcttccataccttagacaaagtaatggtaagattgtggctatgtcgtcttccgcagcgtggctaaccgctccaaggatgagtttttacaatgcaagcaaagcagctttgttgagcttctttgagacgatgagaattgagcttggtggcgatgtacacattacaatcgtcacacctggttatatcgagtcggagctcacacaaggcaagtacttctctggtgaaggcgagttaatagtcaaccaagacatgagagatgttcaagtaggaccatttccggtagcgtcagcatcaggatgtgccaagtcgatagtgaacggtgtgtgccggaaacaaagatacgtgacagagccatcatggtttaaggtgacgtacctttggaaagtgctatgtccggagttgattgagtggggttgtcggttactgtacatgactggaactggtatgtccgaggatactgcactcaacaagaggatcatggacattcctggtgtacgtagtactctgtacccggaatctatcagaactccagaaatcaagtcggattag

SEQ ID NO: 44 - protein, 349 aa, Arabidopsis thaliana
  11-beta-hydroxysteroid dehydrogenase-like [Arabidopsis thaliana].
MELINDFLNLTAPFFTFFGLCFFLPPFYFFKFLQSIFSTIFSENLYGKVVLITGASSGIGEQLAYEYACRGACLALTARRKNRLEEVAEIARELGSPNVVTVHADVSKPDDCRRIVDDTITHFGRLDHLVNNAGMTQISMFENIEDITRTKAVLDTNFWGSVYTTRAALPYLRQSNGKIVAMSSSAAWLTAPRMSFYNASKAALLSFFETMRIELGGDVHITIVTPGYIESELTQGKYFSGEGELIVNQDMRDVQVGPFPVASASGCAKSIVNGVCRKQRYVTEPSWFKVTYLWKVLCPELIEWGCRLLYMTGTGMSEDTALNKRIMDIPGVRSTLYPESIRTPEIKSD

SEQ ID NO: 45 - DNA, 885 bp, Zea mays
  Coding sequence of SEQ ID NO: 46.
atggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccaatacctcctgatccgcgtacccggcgaggagctcaagccggcgtacatggtcatctcctcgccgcctaaagcggggccccggttcgaattcctcgtcaaaagcgtgccgggagctaccgcggggcggctctgcgccctccgagacggggatgttgtggagctcggcgccgtcacggggaaggggttccccctcgacaggataaatccgcccgacgtcgcgcagaccgtgctcatcttcgcggcggggacggggatcagtgcgattcgatcacttatcgagttcggtttcgctgccaaagaaagagctgatgtgaggctttattatggtgatacaagtctgaaatctatgtcataccaggaaaggcttagtaactgggagtcaactggaattaaaataataccagtcttatcacaaccagatgacagctggaaaggtgaacgaggatatgttcaggatgctttcttcagaaacaagaacatagtaaatccatcttctacaggagccatactttgtggaccgaatgaaatgcaggaggaactcaccttatcccttgtagcagatggtgtctcacgagacaaaatcttaacgaactactag

SEQ ID NO: 46 - protein, 294 aa, Zea mays
  Fruit protein PKIWI502 [Zea mays].
MAAVSAAPRPSMPPRLALRAHLFSSASPLPMRALPLLRSRFRSLTTAYAVKQDTALWTPAPVSAISAATDDGSVSLIAVDLSDATDLVDSYTNPGQYLLIRVPGEELKPAYMVISSPPKAGPRFEFLVKSVPGATAGRLCALRDGDVVELGAVTGKGFPLDRINPPDVAQTVLIFAAGTGISAIRSLIEFGFAAKERADVRLYYGDTSLKSMSYQERLSNWESTGIKIIPVLSQPDDSWKGERGYVQDAFFRNKNIVNPSSTGAILCGPNEMQEELTLSLVADGVSRDKILTNY

SEQ ID NO: 47 - DNA, 423 bp, Arabidopsis thaliana
  Coding sequence of SEQ ID NO: 48.
atgtctacttccggtgataaagccacctctagcaccaataaccctaacaactcctacgagattactccaccagccaccgactctatttcgagcttaagttttagtccaaaggccgatatacttgtggcaacttcatgggattgtcaggtgagatgttgggaaataacccgtagtgacggctctatagccagtgaaccaaaggtatcaatgtctcatgatcagccggttttgtgttctgcttggaaagatgatggaaccacagtctttaccggaggatgtgataagcaggcaaaaatgtggccattgttgtctggtgctcaaccatctactgttgctatgcacgatgctcctttcaatcagatagcttggatccctggaatgaatctccttgttactggaagctgggataaaactttgaagtag

SEQ ID NO: 48 - protein, 140 aa, Arabidopsis thaliana
  WD40 domain-containing protein [Arabidopsis thaliana].
MSTSGDKATSSTNNPNNSYEITPPATDSISSLSFSPKADILVATSWDCQVRCWEITRSDGSIASEPKVSMSHDQPVLCSAWKDDGTTVFTGGCDKQAKMWPLLSGAQPSTVAMHDAPFNQIAWIPGMNLLVTGSWDKTLK

SEQ ID NO: 49 - DNA, 1191 bp, Arabidopsis thaliana
  Coding sequence of SEQ ID NO: 50.
atgtattcagaggaaaagaaaagcagaaattatggttcaatctttgtctactgcttcttctgtttcgtactcattgtggaggttgcaagattcgcaaaaccttatatcaaccttcaaaacctaattgagacggaagcagtagtagaagaaggtttcatggcggtggggaactcagggaatcttccgtgtggctcgtcaaaacctagctctgcctctgttcgtgctcatgatgaacagaagctctcgcaagcagtaacaacagatacgagaactcgtcctccaaattcgtactgcgtgaagttccagtcttttgtcactatggcaaagcaggtcaaagaaaacggtggcaagtatgagtcacgtcctttctccgtcggtggatacaattggacgctcctaatctacccagtcatatacattccaacggactcgggtgggtacgtttcgatttacgtaagagtcgataactcaagcctcatcaccaatccaaaagatgtgtatgcagagatcacattcctcgcttataaaagcagtacagacaagtaccaaataagccaggagactgaggcccagcgatttcatttgtttaaacaacagtggggacttttacaatttctaccaatttactattttgaaaatccggcatatggatactttttcgagggcgaaagcgttgtgtttggcgttgacatcaacattgttaaaccctttgaaaattgggaagtgttctctaatgaacaaaacattcgtgaccctattttcgaatggagactcaccaaattctctacacgttttcttgactcttacacttctgattccttttcttccggaggaagaaactgggcattgaaagtgtatccaaatggagttggaaatgctacgggtaattcgttgtcactctatttgttgagtgatcagtcaaatgataagggttatgtggaagctaagttacgagttattgaccagatccaatccaacaatttcgagaaaaaagtggcggcatggcccaatgcaacggagaatggatggggtttcgacaggtttctatcatttgcagatatcaaaaacacatcaaaaggtttcctagtcaacgatactctcaaacttgaagtccagatcttgtccttctcgaaaaccgactactactctcatcaatcgtctcttaatgttttaacgggagatagtacttag

SEQ ID NO: 50 - protein, 396 aa, Arabidopsis thaliana
  ZW9 [Arabidopsis thaliana].
MYSEEKKSRNYGSIFVYCFFCFVLIVEVARFAKPYINLQNLIETEAVVEEGFMAVGNSGNLPCGSSKPSSASVRAHDEQKLSQAVTTDTRTRPPNSYCVKFQSFVTMAKQVKENGGKYESRPFSVGGYNWTLLIYPVIYIPTDSGGYVSIYVRVDNSSLITNPKDVYAEITFLAYKSSTDKYQISQETEAQRFHLFKQQWGLLQFLPIYYFENPAYGYFFEGESVVFGVDINIVKPFENWEVFSNEQNIRDPIFEWRLTKFSTRFLDSYTSDSFSSGGRNWALKVYPNGVGNATGNSLSLYLLSDQSNDKGYVEAKLRVIDQIQSNNFEKKVAAWPNATENGWGFDRFLSFADIKNTSKGFLVNDTLKLEVQILSFSKTDYYSHQSSLNVLTGDST

SEQ ID NO: 51 - DNA, 951 bp, Zea mays
  Coding sequence of SEQ ID NO: 52.
atggagattagggctccgccaacgagcctcagtctcgcgccgccgcccgcctccgccagcttccgccgaacaccgcttaggaccttcttccttaacggcagcgtttcacttaaagttgtgcaagtacgacaatcaaatgtcaacagatttaagtgcaatagcatacaaagtaacctctttgatagactaacgagggttgccaggtcctacgcaaatgcagttctaagttcatttgaggaccctgagaagattctcgagcaggcagttctcgagatgaacgatgacttgacaaagatgaggcaggccacagcacaggtcttggcgtctcaaaagcggcttgagaataaatacaaagctgcagaacaagcttctgctgattggtatcgaagggctcaacttgctcttcaaaagggtgacgaggatcttgctcgcgaagcccttaagcggcgtaaatcatatgctgacaatgcaagctccttaaggtcccagcttgatcagcagaagggtgtagttgaaaatctgatttcaaatacccgggttcttgagagcaagatagcagaggccaagcagaaaaaggatacgcttaaagctcgtgctcaatcagcaaagactgccacaaaagtgagcgaaatgttgggcaacgtgaatacaagtagcgccctttctgcatttgagaaaatggaggaaaaagttatggcgatggaatcccaagcggaggcactcggccaattagcaactgacgatctagaaggaaagtttgcactgctcgagaattcatctgtcgatgatgatctttcacagctgaaaaaagaactctcgggaagctctttgaaaggggagctcccatcaggcagaagagcggccagcaactcaggcgccgggcgccctttccccgacctagagattgagagcgagctaaacgagctgcggaggaaggccaaagaatactag

SEQ ID NO: 52 - protein, 316 aa, Zea mays
  Probable membrane-associated 30 kDa protein, chloroplast precursor.
MEIRAPPTSLSLAPPPASASFRRTPLRTFFLNGSVSLKVVQVRQSNVNRFKCNSIQSNLFDRLTRVARSYANAVLSSFEDPEKILEQAVLEMNDDLTKMRQATAQVLASQKRLENKYKAAEQASADWYRRAQLALQKGDEDLAREALKRRKSYADNASSLRSQLDQQKGVVENLISNTRVLESKIAEAKQKKDTLKARAQSAKTATKVSEMLGNVNTSSALSAFEKMEEKVMAMESQAEALGQLATDDLEGKFALLENSSVDDDLSQLKKELSGSSLKGELPSGRRAASNSGAGRPFPDLEIESELNELRRKAKEY

SEQ ID NO: 53 - DNA, 810 bp, Arabidopsis thaliana
  Coding sequence of SEQ ID NO: 54.
atggcgaaattattcatcaagcaagcagagcaatatgcagcagcccgacccagttaccccaccaaactcttcgaatatatcgcatcgaaaacaccgtgccacgaccttgcctgggacgttggcgccggaagcggccaagcctcacgatcgctagccggaatctacaagaacgtgattgctacagacacgagctcaaagcaacttgaatttgctgcaaagcttcccaacgtccgttacgagatcactccaccgacgatgtcttcatcggagatcgagaagctagtagcacctgaatcatcagttgatttagtcaccgtcgctcaagcccttcattggttcgacctcacgaacttttacagcaacgtgaaacacgtgctcaagaaacccaacggagtaatcgccgcctggtgctacaccaatccggaagttaacgacgccgtggacaaggtctttcaacggttttacgatgagaaacttggtcctcattgggatctagcgcgacggcttgtggaggatgggtacagaggaattgagtttccgttcgagaaagtggataatgatgagtcaacggaaagtcaaagttttccggtgaggtttgtaacggagaaagaaatggtgtttgaagagtatatgacgtatctgaggtcatcttcggcgtatcagacggctaaggagaaaggtttagagcttttgacggctgagatggaaggagagtttgctggttcgtggaaagaagatgggaaagagaagaaagttgttaggtatccgatttatctgttgatcggaagagttgcagaagaacgtgtatag

SEQ ID NO: 54 - protein, 269 aa, Arabidopsis thaliana
  Putative embryo-abundant protein [Arabidopsis thaliana].
MAKLFIKQAEQYAAARPSYPTKLFEYIASKTPCHDLAWDVGAGSGQASRSLAGIYKNVIATDTSSKQLEFAAKLPNVRYEITPPTMSSSEIEKLVAPESSVDLVTVAQALHWFDLTNFYSNVKHVLKKPNGVIAAWCYTNPEVNDAVDKVFQRFYDEKLGPHWDLARRLVEDGYRGIEFPFEKVDNDESTESQSFPVRFVTEKEMVFEEYMTYLRSSSAYQTAKEKGLELLTAEMEGEFAGSWKEDGKEKKVVRYPIYLLIGRVAEERV

SEQ ID NO: 55 - DNA, 1296 bp, Arabidopsis thaliana
  Coding sequence of SEQ ID NO: 56.
atgactttaatcgcttctctgtctctcccaccaccagctatacaaagacaatcactttctgaatttcataatcttcccgctaaatctcaatccttcaattgtcaattccggtcttctagttcacctttatcttctctccattcttcatcgcttagtaactttctagattttagactaaggcggagaaacagcggattggttccagtggtggcgtgttcaacgacgccgtttatgggcagagttggattacattggagagatgggaatatgtctctgttatcgttttgtggtggaactgatgttacagagaaagctgattcgtctcagttttggtctgctttgcttccatttgttgttgctctcactgccgttgctgctctctcttacccacctagtttcacttgggtatctaaagacctctatgctcctgctcttggagggattatgttatctattggaattcagctttcagttgacgattttgctcttgcattcaaaagaccagtgccgttatctgttgggtttgttgctcagtacgttttgaaaccgcttctcggggttttagttgctaatgcatttgggatgccgaggaccttctacgctggttttatactcacgtgttgtgtggctggggctcagttgtctagttacgcgagttctctgagtaaagctgatgtggccatgagcattcttctcactagttctacaactattgcttctgtaatctttacacctttgcttagtggtcttctaattggatcagtagttcctgttgatgcagttgccatgtcgaagtctatacttcaggtggtacttgttccaatcactcttggccttgtgttaaatacttatgcgaagcctgtggtcactcttcttcaacctgtgatgccgtttgttgctatggtatgcacttcgttgtgcattggaagcccactttcgattaatcgcagtcagattctgtcagctgaaggtcttggattgattgttccaattgttacattccatgccgtagcatttgccttaggatattggttctctaagatcccaggcttacgacaagaggaagaagtaagccggactatctccctttgcacgggaatgcaaagctccacattagccgggcttcttgcaagccagttccttggtagcagccaagccgtgccagcagcttgctctgtagttgtaatggccataatgggtctatgccttgcctctttctggggcaatgggtttcgaatcagggacgttctatcgctatcaacaccgcaaagcactggctacaccgctgaatcatag

SEQ ID NO: 56 - protein, 431 aa, Arabidopsis thaliana
  Putative sodium-bile acid cotransporter [Arabidopsis thaliana].
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTEKADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLVLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVVMAIMGLCLASFWGNGFRIRDVLSLSTPQSTGYTAES

SEQ ID NO: 57 - DNA, 1239 bp, Arabidopsis thaliana
  Coding sequence of SEQ ID NO: 58.
atggcggaggagaaatgggtggtgatggtgacggcgcagactccaacgaatatcgccgtgattaagtattggggaaagagagatgaggttcggattcttcccattaatgatagcattagcgtcacgcttgatcctgatcacctctgtactctcaccaccgtcgctgttagtccttcctttgatcgagatcgaatgtggctcaatggcaaggaaatctcgctttctggaagtaggtaccagaattgcttgagggaaattcgaagtcgtgctgatgatgtagaagataaagaaaagggtatcaagattgcgaagaaagattgggagaagctgcatctgcacattgcttctcataacaacttccctactgctgctggcttagcatcttctgctgctggttttgcttgcttagtttttgctcttgccaagttgatgaatgtaaatgaagatccaagccaactttctgctatagcaaggcaaggttcaggaagtgcttgccgtagtttatttgggggatttgtcaagtggaatatgggaaacaaagaagatggaagtgacagtgttgcagttcaactggtagatgataagcactgggatgatcttgttatcattattgctgtggttagttcacgacagaaggaaacaagcagcacctcgggaatgcgtgagagtgttgagacaagtttgcttttacagcatagagcaaaggaagttgtcccagtacggattttgcaaatggaagaagctataaagaatcgagatttcacatcttttacaaaattgacgtgttcagacagtaatcagtttcatgctgtttgtatggatacatctccacccatattctacatgaatgacacctcccacaggataatcagcttagttgaaaagtggaaccgttctgccggtacaccagagattgcttatacatttgatgctggcccaaatgcagtcatgattgcaagaaacaggaaagtagcagttgaattgctgcaggggctgctctactgcttccctcctaagcctgacacagacatgaagagttacgtactgggggatacatcgatagtaaaagaggcaggcttggaaggagagcttccacaaggaattaaagacaaaattggaagtcaggatcaaaaaggtgaagtgagttattttatatgcagcagacctggaagaggtcctgtggtgcttcaagaccaaactcaagctcttctccatcctcaaactggcctccccaaatag

SEQ ID NO: 58 - protein, 412 aa, Arabidopsis thaliana
  Mevalonate diphosphate decarboxylase [Arabidopsis thaliana].
MAEEKWVVMVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 59 - DNA, 975 bp, Saccharomyces cerevisiae
  Coding sequence of SEQ ID NO: 60.
atgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattag

SEQ ID NO: 60 - protein, 324 aa, Saccharomyces cerevisiae
  Mitochondrial oxaloacetate transport protein [Saccharomyces cerevisiae].
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 61 - DNA, 3558 bp, Saccharomyces cerevisiae
  Coding sequence of SEQ ID NO: 62.
atgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatccccaaaaaaagtaatttttactcgttag

SEQ ID NO: 62 - protein, 1185 aa, Saccharomyces cerevisiae
  Pyruvate carboxylase 2 [Saccharomyces cerevisiae].
MSSSKKLAGLRDNFSLLGEKNKILVANRGEIPIRIFRSAHELSMRTIAIYSHEDRLSMHRLKADEAYVIGEEGQYTPVGAYLAMDEIIEIAKKHKVDFIHPGYGFLSENSEFADKVVKAGITWIGPPAEVIDSVGDKVSARHLAARANVPTVPGTPGPIETVQEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKVCGYRNAGTAEFLVDNQNRHYFIEINPRIQVEHTITEEITGIDIVSAQIQIAAGATLTQLGLLQDKITTRGFSIQCRITTEDPSKNFQPDTGRLEVYRSAGGNGVRLDGGNAYAGATISPHYDSMLVKCSCSGSTYEIVRRKMIRALIEFRIRGVKTNIPFLLTLLTNPVFIEGTYWTTFIDDTPQLFQMVSSQNRAQKLLHYLADLAVNGSSIKGQIGLPKLKSNPSVPHLHDAQGNVINVTKSAPPSGWRQVLLEKGPSEFAKQVRQFNGTLLMDTTWRDAHQSLLATRVRTHDLATIAPTTAHALAGAFALECWGGATFDVAMRFLHEDPWERLRKLRSLVPNIPFQMLLRGANGVAYSSLPDNAIDHFVKQAKDNGVDIFRVFDALNDLEQLKVGVNAVKKAGGVVEATVCYSGDMLQPGKKYNLDYYLEVVEKIVQMGTHILGIKDMAGTMKPAAAKLLIGSLRTRYPDLPIHVHSHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDIRRLANSLDFPDSVMDFFEGLIGQPYGGFPEPLRSDVLRNKRRKLTCRPGLELEPFDLEKIREDLQNRFGDIDECDVASYNMYPRVYEDFQKIRETYGDLSVLPTKNFLAPAEPDEEIEVTIEQGKTLIIKLQAVGDLNKKTGQREVYFELNGELRKIRVADKSQNIQSVAKPKADVHDTHQIGAPMAGVIIEVKVHKGSLVKKGESIAVLSAMKMEMVVSSPADGQVKDVFIKDGESVDASDLLVVLEEETLPPSPKKVIFTR

SEQ ID NO: 63 - DNA, 699 bp, Zea mays
  Coding sequence of SEQ ID NO: 64.
atggcggcttcttgcgcctccacactccctccactttccttcgtttcctcctccagttcaccccgccgattcaggcgctctggtgtggtggccatggccagcgttgggcagaaggtgtatgcgcccggtgtggcggtgtcggagggcaatggcgggctgccgaaaatcgacctcaaatccccgcacgggagcgaggctgagatttatctgtttggagcgtgtgttacttctttcaaagtccctaatggcaaggacctgctctttgttcgaccagatgctgtgtttaatggacagaaacccatcagcggtggaattccacattgtttcccccagtttggcccaggtcccatgcagcagcatgggtttgcacggaatgtgaattggtctatcacagattcagaagtcacagaaggagatccagctgtaactttggaactgaaagatgacacttatagccgttctatgtgggatttcagcttccatgcactgtacaaggtttccctgcactctaaaagcttgtcaacaactctagcaataataaatacagatgacaagcctttctcattcaactcagccctccacacttatttcagtgcttccataactggcgtttctgtgaaaggtctaaaaggttgcaagactctcaataaggaccctgacccgaaaaatcctttggagggcaaagaagagagtatttag

SEQ ID NO: 64 - protein, 232 aa, Zea mays
  Aldose 1-epimerase.
MAASCASTLPPLSFVSSSSSPRRFRRSGVVAMASVGQKVYAPGVAVSEGNGGLPKIDLKSPHGSEAEIYLFGACVTSFKVPNGKDLLFVRPDAVFNGQKPISGGIPHCFPQFGPGPMQQHGFARNVNWSITDSEVTEGDPAVTLELKDDTYSRSMWDFSFHALYKVSLHSKSLSTTLAIINTDDKPFSFNSALHTYFSASITGVSVKGLKGCKTLNKDPDPKNPLEGKEESI

SEQ ID NO: 65 - DNA, 1164 bp, Zea mays
  Coding sequence of SEQ ID NO: 66.
atggcagcggtcgccgcccaccaccacctccacccctcctccgtcgctgcccgaactccaacacttggccgacgccaccgtttctcgtcgcttcctctcgccgcgcggccgtcctcccaaggccgtttcagcttccgagccgcgacccgcgtcctcacgcgcgccggaagcactggcgccagcagcgccgcctcgcccgccgcgacgacggcgtcgtcgttgtcgctggaggagctgcgcgggggctgtaccacctggacgtggcgagggatgcgcgtgaactacctcgccagaggacaggggccgcccgtactgctcgtccacggcttcggcgcctccgtcgcgcactggcgcaggaacattggggtgttgtctgaatcctataccgtctacgcgatcgatttgctggggtttggcgcgtcggacaagcctcctgggttttcttacacgatggagacatgggccgagctgatactggatttcttggaggaggtggtcaggaggcccacggtgcttgtcgggaactcggttggaagcctcgcgtgcgtcattgctgcatcagagtccagcagagaagccgtccgggggcttgtcctgctgaactgcgccggtggcatgaacaacaaggcgatcgtcgatgactggcggatcaagctgctcctgccactgctctggctgatcgacttcctgctgaaacagcggccgatagcatcagcgctctttaaccgcgtgaaaaacagggacaatctgaaggacatcttgctctctgtttatgggaacaaagatgctgtggacgatgaattggttgagatcatacgcggaccggctgacacggagggcgccctggacgcgttcgtgtcgacggtgaccggcccgccggggccaagcccgatagccctgatgccgcggctggccgacctgcccgtgctggtgctgtggggtgaccgggaccccttcaccccgatcgacgggcccgtggggaagttcttctcgaagctgccgtcggagctcccgaacgtgacgctctacatgctggagggcgtggggcactgcccgcacgacgaccggccggacctcgtccacgacaggctgctgccgtggcttgaagcgctcctgccgcccgccgccggcgcggtgactacgacgacgacgacggttgtctag

SEQ ID NO: 66 - protein, 387 aa, Zea mays
  Alpha/beta hydrolase fold [Zea mays].
MAAVAAHHHLHPSSVAARTPTLGRRHRFSSLPLAARPSSQGRFSFRAATRVLTRAGSTGASSAASPAATTASSLSLEELRGGCTTWTWRGMRVNYLARGQGPPVLLVHGFGASVAHWRRNIGVLSESYTVYAIDLLGFGASDKPPGFSYTMETWAELILDFLEEVVRRPTVLVGNSVGSLACVIAASESSREAVRGLVLLNCAGGMNNKAIVDDWRIKLLLPLLWLIDFLLKQRPIASALFNRVKNRDNLKDILLSVYGNKDAVDDELVEIIRGPADTEGALDAFVSTVTGPPGPSPIALMPRLADLPVLVLWGDRDPFTPIDGPVGKFFSKLPSELPNVTLYMLEGVGHCPHDDRPDLVHDRLLPWLEALLPPAAGAVTTTTTTVV

SEQ ID NO: 67 - DNA, 1023 bp, Zea mays
  Coding sequence of SEQ ID NO: 68.
atggcggaggagatggcgcaggcgcaaccgagactcacggcgccacgttcggtccgctgtattgtcaagctaggtggagcggcgattaccaacaagggcgagctggagagcatcaacgaggagaacctacggtcggcatgtgcgcagctgcggcatgccatgtccgaatctgacggcgatggcgccatggagaaggttctgggaatggactggagtaggaagcccggagatcctgtcgacccggccgttgacgcggagtggatcgcggggatagctaggctggggctcgacactaacttcgtcgtcgtgcacggggccgggtcttttggccactttcaagcaagtagatctggagttcataaaggagggttacattcgacactggtcaaggctggctttgttgctacaagaatttcagtgacatctctcaaccaggaaattgttagagccctagcaagagaaggaataccatctgttgggatgtcaccatttgcttgtgggtggtctacccaacaaagaaaacttgcatcagcaaatgcttctcaaatatttcagtcactccatgcaggttttgtcccagttttgcacggtgatgcagttcttgatgaattattggactgtaccatattgagtggggatgtcattatacgacatcttgcacagcttctgagtccgaaatatgtagtatttctgacagatgtccatggagtgtatgatcgccctccaactgactcaaatgcagtacttctgagagaaatagaggtggatgacattggaggctggtcgattgtaaaacctgcattgctgcaaggcaacactaaaggagtggagatatcagttgcagcacatgacaccaccggtgggatggagaccaaaatactggaggctgcagtgatagctaggcttggaatagacgtgtatattaccaaggctggaacagaacactcgctgagggccttgaagggagatgtgagcaccgactcggaagattggcttggaactattatacgctcttccaaatag

SEQ ID NO: 68 - protein, 340 aa, Zea mays
  Hypothetical protein.
MAEEMAQAQPRLTAPRSVRCIVKLGGAAITNKGELESINEENLRSACAQLRHAMSESDGDGAMEKVLGMDWSRKPGDPVDPAVDAEWIAGIARLGLDTNFVVVHGAGSFGHFQASRSGVHKGGLHSTLVKAGFVATRISVTSLNQEIVRALAREGIPSVGMSPFACGWSTQQRKLASANASQIFQSLHAGFVPVLHGDAVLDELLDCTILSGDVIIRHLAQLLSPKYVVFLTDVHGVYDRPPTDSNAVLLREIEVDDIGGWSIVKPALLQGNTKGVEISVAAHDTTGGMETKILEAAVIARLGIDVYITKAGTEHSLRALKGDVSTDSEDWLGTIIRSSK

SEQ ID NO: 69 - DNA, 261 bp, Arabidopsis thaliana
  Coding sequence of SEQ ID NO: 70.
atgagcagaggaaaactagaactttctatgatttgcttgagagaggtgagatcggtgttgtcgcctctgaagagtgaatgggaatgcctctctctcactctcaatgttgttggctcgatttttctgtttttatggtttcttgagatctcagataagttacctaagaaagttggttgcttgagaaataaacaaccactcagacatcaaaattggatatttgttaacacattgttttccggagatacagtggttgaaacttag

SEQ ID NO: 70 - protein, 86 aa, Arabidopsis thaliana
  Putative cytochrome c oxidase subunit [Arabidopsis thaliana].
MSRGKLELSMICLREVRSVLSPLKSEWECLSLTLNVVGSIFLFLWFLEISDKLPKKVGCLRNKQPLRHQNWIFVNTLFSGDTVVET

SEQ ID NO: 71 - DNA, 837 bp, Arabidopsis thaliana
  Coding sequence of SEQ ID NO: 72.
atggcgtatcaccaaccgtacgatcctttctacgtctatcaacttcattctcatcctcatcatcttccgccgcagctgccactgctcgccgacgaacctggggcgattaacactctctttgtctctggcttgcctaatgacgttaaggctcgtgagatccacaatctcttccgtcgtcgtcatggattcgaatcttgtcagctcaagtacactggacgcggtgaccaggttgtggcatttgcaacattcacgagtcatagattcgccttggctgcaatgaatgagctaaatggtgtgaaatttgatcctcaaacaggatcaaatctacatatagaactagctagatcaaactctagaagaaaagaaaggccaggaagtggaccttatgttgtgattgataacagaaacaaggaaatttctaagtctcaggatgaccagagtgatgaaggggatagcgatccagatgaggtgcaggaacctggaaatagcgattctccaaaggaaaacgatactaccaaaagcgaagcggattctgagccagatagtaaagcaccatctgctaatgggcacttagagaaagcatctgaaggaggttctggtgctcgagcttgttcgaccttgtttatagctaatctagggcctaattgtacagaagatgaactcaaacaactcctatctagatatcctggtttccacattttaaaaatccgagctagaggcggaatgccggttgcatttgctgattttgaggaaatcgagcaagctactgatgccatgaatcatcttcaagggaacctcttatcctcttcagaccgaggcggcatgcatatagagtag

SEQ ID NO: 72 - protein, 278 aa, Arabidopsis thaliana
  RNA recognition motif-containing protein [Arabidopsis thaliana].
MAYHQPYDPFYVYQLHSHPHHLPPQLPLLADEPGAINTLFVSGLPNDVKAREIHNLFRRRHGFESCQLKYTGRGDQVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANGHLEKASEGGSGARACSTLFIANLGPNCTEDELKQLLSRYPGFHILKIRARGGMPVAFADFEEIEQATDAMNHLQGNLLSSSDRGGMHIE

SEQ ID NO: 73 - DNA, 1092 bp, Oryza sativa
  Coding sequence of SEQ ID NO: 74.
atgagctctctatgcccctttgccaaactcgcctccgctggcgccacatgccccgtaaaatcatcatcagacaacaaaaccaccatcaatcacaccgacgacgacgacgacgacaatgaaaaaactggcaatgctaacaccgatcctcgtgtggtgccaccaaagtgcccctttggctatgactccaacaccttcaagcttggcccactcagctgcatggtctgccacgctctgctacatcaaagcagcaaatgcaccccgtgctcccacaagttctgcaaggcatgcatattgcgctttaaggactgtccattgtgtggtgctgacatccaagggatcgagcccgatgatgagcttcaaggccttgtcgaccgcttcattgatggccatgcccgaatcaagagatcacatgctgcaggcgatggggaagccgcaagtgacaacaagaccaaggtcatttacgaggatgtctccatggagagaggggcttttctggtccagcaagcgatgagggcctttcgcgcacagaacattgaaagtgcaaagtcaaggctcagtatgtgtgcacaagacatcagggaagaattgaaatctaaacaagacaaccaagaactgtgttctcaacttggagctgtgttaggaatgcttggggactgctgtcggaccttgggagatgctccttcagcaatcacttactatgaagaaagtgctgaattcctctcgaaattgcccaaaaaagatctggagttggtccatactctctcagtttcactaaataaaattggagatcttcgctattatgatggggacctccactcagcaagaagctattatgcgcgttcgttggatgttcgcagaagtgcagcaaaagaacactcagctgtggcttcccaggtcattgatgtagcaacttctcttgccaaagttgcggatgtcgatagaaatcttgggaacgaaagcatggcagttgagggttttgaggaagcaattaaatgccttgagaatttgaagctggaatctggagaggccagtcttgagcagcggcgtctctcggttctcgactttctacaaaaacaattggatgacaagtag

SEQ ID NO: 74 - protein, 363 aa, Oryza sativa
  RING finger-like protein.
MSSLCPFAKLASAGATCPVKSSSDNKTTINHTDDDDDDNEKTGNANTDPRVVPPKCPFGYDSNTFKLGPLSCMVCHALLHQSSKCTPCSHKFCKACILRFKDCPLCGADIQGIEPDDELQGLVDRFIDGHARIKRSHAAGDGEAASDNKTKVIYEDVSMERGAFLVQQAMRAFRAQNIESAKSRLSMCAQDIREELKSKQDNQELCSQLGAVLGMLGDCCRTLGDAPSAITYYEESAEFLSKLPKKDLELVHTLSVSLNKIGDLRYYDGDLHSARSYYARSLDVRRSAAKEHSAVASQVIDVATSLAKVADVDRNLGNESMAVEGFEEAIKCLENLKLESGEASLEQRRLSVLDFLQKQLDDK

SEQ ID NO: 75 - DNA, 1551 bp, Arabidopsis thaliana
  Coding sequence of SEQ ID NO: 76.
atgggttctggtcaatggcatatggagaagaggtctactttaaagaatgattcgtttgtaaaagaatacaatccagtcacggaaactgggagtctctctatcattgttcttggtgcttctggtgatcttgctaagaagaagacttttcctgcacttttcaatctatttcatcagggatttcttaatccagatgaagttcatatatttggatatgcaaggagtaagattactgatgaggagcttagagataaaatccgcggatatcttgttgatgagaagaatgcatctaagaaaacagaagctttgtccaagtttctaaagctgattaagtatgtgagtggaccttatgattctgaggaagggtttaagagattagacaaggcgattttggagcacgagatatctaaaaagactgctgaaggatcttcgaggagattgttttatcttgcacttcctccgtctgtataccctcctgtaagcaagatgatcaaggcatggtgcactaacaaatctgatcttggtggatggactaggattgttgttgagaaaccatttggaaaggatttggaatctgcagagcagctgagttctcagattggagccttgtttgaagaaccacagatttatcgtattgatcactatctgggaaaagagttagttcaaaacatgttggttcttcggtttgccaatcgcttgtttttgccactatggaaccgcgacaatattgcaaacgtacagatcgttttcagagaagattttggaactgaaggtcgcggtggatattttgatgaatacggaatcattcgtgatattattcaaaaccacttgctccaggttctttgccttgtcgccatggagaaaccaatctctcttaaacccgagcacatccgggatgagaaagtgaaggttcttcaatctgtgattcccataaaagatgaagaggtggttcttggacaatatgaaggatatagagatgatccaactgttccaaatgactcaaacactccaacgtttgccacaacaattcttcgcattaacaatgaaagatgggaaggtgttccttttatactgaaggccggaaaggcaatgagttcaaagaaggcagatattcgcattcagtttaaagatgttcctggcgacatattcaaatgtcaaaaccaagggaggaacgagtttgttatacgcttgcagccttcagaggccatgtacatgaagctaactgtgaagcaaccgggtctggagatgcaaaccgtgcagagtgaactagacctatcgtacaagcagcgttaccaagatgtctcaattccagaggcttacgaacgccttattcttgacacaatcagaggcgaccaacaacactttgttcgcagagacgaattaaaggcagcttgggaaatcttcactccactgcttcacaggatcgacaagggagaagtgaaatcggtcccatacaaacaaggtagccgtggcccagcggaagcagatcagctacttaagaaagctggttatatgcagactcatggctacatttggatccctcctacattgtag

SEQ ID NO: 76 - protein, 516 aa, Arabidopsis thaliana
  Glucose-6-phosphate 1-dehydrogenase [Arabidopsis thaliana].
MGSGQWHMEKRSTLKNDSFVKEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 77 - DNA, 753 bp, Zea mays
  Coding sequence of SEQ ID NO: 78.
atgaagttcggcaagcgcctcaagaagcagatcgaggagagcctgccggagtggcggagccagttcctcaactacaaggagctgaagcggcgcgtgaatgccgtgtcctcccgcgggtcggcggcggatccgtcgtcgtccagcgccgcggaggccgacttcctgacgctcctggacgccgagatcgacaagttcaacgccttcttcctggagcgggaggaggagttcgtgatccggcagagggagctccaggagcgcatcgggcgtgcgggcgggcccgaggccacgctggcgcgcgtccggcgcgaggtggtggacttgcacggcgagatggtgctgctgctcaactacagcagcgtcaactacacgggcctcgccaagatcctcaagaagttcgacaagcgcaccggcggcgtgctccgcctccccgtcatcgcgcgggtgctgcggcagcccttcttcaccaccgacctcatctccgagctggtcagggactgcgaggccgcgatggaggccgtcttcccgcccgccgccagcagggacctccacgggcgccaggcgctggccgtcgccgggcagggcatcttccgcaacaccgtcgccgctctgctcaccatgcaggaggtgcgcagcgggagctccaccgtcggccatttctcgctgccgcccatgcagccgctgccggagtcggactggctcgtccagtccgttgacagcacgccgacggcgtcgcccctcatccccacccagtag

SEQ ID NO: 78 - protein, 250 aa, Zea mays
  Ids4-like protein [Zea mays].
MKFGKRLKKQIEESLPEWRSQFLNYKELKRRVNAVSSRGSAADPSSSSAAEADFLTLLDAEIDKFNAFFLEREEEFVIRQRELQERIGRAGGPEATLARVRREVVDLHGEMVLLLNYSSVNYTGLAKILKKFDKRTGGVLRLPVIARVLRQPFFTTDLISELVRDCEAAMEAVFPPAASRDLHGRQALAVAGQGIFRNTVAALLTMQEVRSGSSTVGHFSLPPMQPLPESDWLVQSVDSTPTASPLIPTQ

SEQ ID NO: 79 - DNA, 1431 bp, Arabidopsis thaliana
  Coding sequence of SEQ ID NO: 80.
atggcgttacaaaggcaactcctgaagagagctacttccgatatctatcaccgccgtgcgatctctctcctccgtactgatttctctacttctccttcgattgctgatgctccgccgcacattccgccgttcgttcaccagccacggccgtataaaggtccttccgccgatgaggttttacagaaacggaagaagtttctcggaccttctcttttccactactaccagaagcctcttaacatcgttgaagggaagatgcagtacttgtatgatgagagtggtaggcgatatctggatgcctttgctggaatagtcactgtgtcgtgcggtcactgccatccggatattcttaatgcgattacggaacagagcaagctacttcagcacgcgactactatttacctgcatcatgccattggtgattttgctgaagcattggctgccaagatgcccggaaatcttaaggttgtgtactttgtgaattctggctcagaagctaatgagctagcaatgatgatggctaggctttacactggtagccttgagatgatttccttgagaaatgcttatcatggtggaagttccaatactattggactaactgctcttaacacatggaagtacccattacctcagggggaaatccatcacgtagtaaatccagatccataccgtggagtttttggctctgatggttctctttatgctaaagatgttcatgaccacatcgagtatggtacctctggaaaagtagctggatttatcgcagagaccatccagggggtcggaggagctgtagaattggctcctggttacttaaagtcggtttatgaaattgttcgcaacgctggtggtgtatgcattgctgatgaagtccaaactggatttgggcgaacaggaagccactattggggtttccagactcaagatgtggttcctgacatagtcacaatggcaaagggaattggaaatggattgccattaggagctgtggtgactacaccagaaatcgcaagtgttttagctagcaagattctgttcaacacttttggtgggaacccggtttgttcagctggtggacttgcggttctaaacgttattgataaggagaaacgccaagaacattgtgctgaagttggttcacaccttatacaacgtttgaaagatgtgcagaaaagacatgatatcattggagacgtgagaggaagagggttaatggttgggattgagcttgtgagtgaccggaaagacaagacaccagccaaggctgaaacatctgtcttgtttgagcaacttagagaacttggcattctcgtcggaaaaggaggacttcatgggaacgttttcaggataaagccaccaatgtgtttcactaaagatgatgcagatttcttggtagatgcattggactattccatctccaggttgtag

SEQ ID NO: 80 - protein, 476 aa, Arabidopsis thaliana
  Alanine:glyoxylate aminotransferase 2 homolog [Arabidopsis thaliana].
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVHDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 81 - DNA, 558 bp, Zea mays
  Coding sequence of SEQ ID NO: 82.
atgatttccatcggctttctggcggcaaccggagtacgggtggcgaacgagctgggagccgggagcgcgaggagggccaagttcgccatctacaacgtggtggccacctcctccatcatcgggtccgtgctgttcgtgctgttcctcctcttccgcggaggcctcgcctacatattcaccgacagccaggcggtggcggacgcagtcgccggcctctcgcccctgctggccttctccatactgctcaacagcgtccagccagtgctgtcaggcgtcgctgtcggcgcgggctggcagagcgtcgtcgcctacgttaacatcacttcgtactacctcatcggcatccctcttggagccgtgctgggctacgcgctggggcttcatgtgaagggcatctggatcggcatgctgctcggaacgctggtccagactgttgtgcttctcttcataacgttgaagaccgactgggaaaaacaggtggaggttgctcaagagaggctgaagagatggtacatggaagagaacagaagactccaggggtccagacgaaacccttag

SEQ ID NO: 82 - protein, 185 aa, Zea mays
  MATE efflux family protein.
MISIGFLAATGVRVANELGAGSARRAKFAIYNVVATSSIIGSVLFVLFLLFRGGLAYIFTDSQAVADAVAGLSPLLAFSILLNSVQPVLSGVAVGAGWQSVVAYVNITSYYLIGIPLGAVLGYALGLHVKGIWIGMLLGTLVQTVVLLFITLKTDWEKQVEVAQERLKRWYMEENRRLQGSRRNP

SEQ ID NO: 83 - DNA, 1524 bp, Zea mays
  Coding sequence of SEQ ID NO: 84.
atgtcaggaggatcttcaccatcatcaaggcgaaacagctttaattctttgtctaaggacctagaccttccttcagagcaaggttgtctctccattgttgtacttggggcttctggtgaccttgttaagaagaaaacattcccagccctctaccacctctttgagcagggattcatacaatctggagaagtccatatatttggttatgctagatcaaatctttctgatgatgggttaagagaacgcattcgtgggtatctcaaaggagccccagaagatctttcagaatttttgcaactaataaaatatgtcagtggttcctatgatactggagaaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccctggatggaccagagtcattgttgagaagccctttggaaaggacttggattccgctgaagaattaagtgcccaacttggggagctattcgaggaacaccaactatacaggatagaccattacctgggaaaagagttggtccaaaacttgcttgttcttcgttttgccaaccgattattcttgcctctttggaaccgcgacaatattgataatatacagattgtattcagggaagactttggtactgaagggcgtggaggatattttgaccaatatggaatcattcgtgatatcattcagaatcatttactgcaggttttctgtttggttgcaatggaaaagcctgtctcccttaagcctgagcacatcagagatgagaaagtcaaggttctgcaatctgtgaaccctattaagcctgaagaggtagtccttgggcaatacgatggctacaaggatgaccctacagtgccagatgactcgaataccccaacttttgcatctgttgttcttcgggtacacaatgaaagatgggaaggtgttcctttcattcttaaagctggtaaagcattgagttcaaagaaagcagaagttcgggtgcaattcaaggatgtccctggtgacatttttagaagcaagaagcaaggaagaaatgagtttgttatacgcctccaaccatcagaagccatgtacatgaaactaactgttaagaagcctgggttagaaatggctactgaacaaagtgaacttgatctgtcatatgggatgcggtaccaaaatgtcaaaattcctgaggcatatgaacgccttatcttggatacaataagaggtgatcagcagcactttgttcgcagagatgagctacaggctgcttggaagatcttcactcctttgctgcatgacattgacgacggcaagctgaaggccctcccgtatgaacctggcagccggggacccaaggaagccgacgaattgagcgcgagagttggatacgtgcagacccacggttacataggggtaccgccgacccttgcatag

SEQ ID NO: 84 - protein, 507 aa, Zea mays
  Glucose-6-phosphate 1-dehydrogenase, cytoplasmic isoform [Zea mays].
MSGGSSPSSRRNSFNSLSKDLDLPSEQGCLSIVVLGASGDLVKKKTFPALYHLFEQGFIQSGEVHIFGYARSNLSDDGLRERIRGYLKGAPEDLSEFLQLIKYVSGSYDTGEGFEKLNRAISEYEVSKSSGSYRRLFYLALPPSVYPSVCKMIRTYCMNPSSHPGWTRVIVEKPFGKDLDSAEELSAQLGELFEEHQLYRIDHYLGKELVQNLLVLRFANRLFLPLWNRDNIDNIQIVFREDFGTEGRGGYFDQYGIIRDIIQNHLLQVFCLVAMEKPVSLKPEHIRDEKVKVLQSVNPIKPEEVVLGQYDGYKDDPTVPDDSNTPTFASVVLRVHNERWEGVPFILKAGKALSSKKAEVRVQFKDVPGDIFRSKKQGRNEFVIRLQPSEAMYMKLTVKKPGLEMATEQSELDLSYGMRYQNVKIPEAYERLILDTIRGDQQHFVRRDELQAAWKIFTPLLHDIDDGKLKALPYEPGSRGPKEADELSARVGYVQTHGYIGVPPTLA

SEQ ID NO: 85 - DNA, 1776 bp, Zea mays
  Coding sequence of SEQ ID NO: 86.
atggagccgccgactgggttctgggcctcgcttctgagcttcctcaagttcctcccctacttctgcggcctcctcgtccttggactcatcaaaggtgttttgttgtgcccttgggcatgtctgattatggcgattggaatatctgccctggtcctgggcttatggcctatgcatctgatttggacatactactgcattgtcagaaccaagctggttggacctgtggtaaagcttctgcttcttattgctgcgactgcagtcttgatcatatggttgataattggcatcccgggaagcatatttgctggattggtatatggttttctagcacccataatggctacatttgatgctgtaggagaaggcaaagaaaagccatttgttcattgctttgtggatggaacatggagtactatcactggaagctgtacagtagtcagggacgtgaaagatttgcttttccactcctatttttcacttatggatgaccttcgtcttcagaaacctcctgacggggagccatatgagataagattgcttgatattcctggtgcactaatagcggctgcatttgggcttctacttgatggaataatgttcacattaattgccttctataagtgccccgtgatgcttttcaaaggatggaaacgactgatccaggacatgattgggagagaagggccctttctggagactgcttgtgtgccatttgctggtcttgctattcttctttggccatttgctgtagtaggagccgttctggcatccatactctccagtgcccctttaggtgcttatgctgcagttgtagcttatcaggaatcctcccttatcctgggaattgcctatgtgttctcgtcggtgtctatatttgatgaatacacaaatgatgttcttgacatggcgcctggttcttgttttccaagatttaaatatcggaagggcaaagatgagtcttcacacgggcacagtgttccattatccagaccagcctcattcaatagggagaagcaagaagggaaaaggcctccgtctcgtgttacttcatttaagaacagcattgatgatttcaatccattcaagctgctggaccacctatttgccgaatgcaggaaccagggggaggatttggttaacagaggagtgataacaatgaaggacattgaagaaacgaagtctggcaaagttggcagcggtgttcttaatgttggtctaccagcgtatgttattcttaatgcactccttcggtctgcgaaagctgattctgtcgggctaatcttaagtgacggctctgagattacatctgacaatagacctaaaaacaccatctttgattggttctttgaccctcttatggttataaaggaacagatcaaagctgagaatctcactgacgaagaggaagagtatctgaaaatgcgagtgctattggctggtgatcccagtcgcctgaaaggctctctgcctcatgttccatccttgactgaacgtaaaaaggcagatatagacgcattcgctcgcaggttgcaaggaatcacaaagtcgatatctagatatcctacatcaaagcgccgcttcgacgtccttgtgaaggcgctcttgtcagagctggagaggacgatgggccaatctggcaatggatcccagtcccaggcgcagaggctgcgaaactcggtagcccggatgttgagccagaaatctatgggcaagactgccaacattagggatgaagacccagaagcgcagatgacgagactgtctcgcaccccgtag

SEQ ID NO: 86 - protein, 591 aa, Zea mays
  Hypothetical protein.
MEPPTGFWASLLSFLKFLPYFCGLLVLGLIKGVLLCPWACLIMAIGISALVLGLWPMHLIWTYYCIVRTKLVGPVVKLLLLIAATAVLIIWLIIGIPGSIFAGLVYGFLAPIMATFDAVGEGKEKPFVHCFVDGTWSTITGSCTVVRDVKDLLFHSYFSLMDDLRLQKPPDGEPYEIRLLDIPGALIAAAFGLLLDGIMFTLIAFYKCPVMLFKGWKRLIQDMIGREGPFLETACVPFAGLAILLWPFAVVGAVLASILSSAPLGAYAAVVAYQESSLILGIAYVFSSVSIFDEYTNDVLDMAPGSCFPRFKYRKGKDESSHGHSVPLSRPASFNREKQEGKRPPSRVTSFKNSIDDFNPFKLLDHLFAECRNQGEDLVNRGVITMKDIEETKSGKVGSGVLNVGLPAYVILNALLRSAKADSVGLILSDGSEITSDNRPKNTIFDWFFDPLMVIKEQIKAENLTDEEEEYLKMRVLLAGDPSRLKGSLPHVPSLTERKKADIDAFARRLQGITKSISRYPTSKRRFDVLVKALLSELERTMGQSGNGSQSQAQRLRNSVARMLSQKSMGKTANIRDEDPEAQMTRLSRTP

SEQ ID NO: 87 - DNA, 1167 bp, Arabidopsis thaliana
  Coding sequence of SEQ ID NO: 88.
atgatcaaaacaatcacatctctacgcaaaactctggttctacctcttcatttacatattcgtacgctacaaactttcgccaagtacaacgcacaagctgcatcggctttgcgagaagagcgtaagaaacctctttatcaaaatggagatgatgtatatgcggatttggattgggataatctcgggtttggtctaaatccagctgattacatgtatgtcatgaaatgctcaaaagacggcgaattcactcaaggagaacttagtccctatgggaatattcagctaagtccttctgctggagtcttaaactatggacaggcgatatacgaaggtacaaaagcatacaggaaagaaaatgggaagcttcttttgtttcgtccggatcacaacgctatccggatgaagcttggcgctgaacggatgctcatgccttctccttcggttgatcagtttgttaatgcagttaaacaaaccgctcttgcaaacaaacgttgggttcctcctgcagggaaagggactttgtacattaggcctttgttgatgggaagtggtccaatacttggtttaggtcctgcacctgaatatacattcattgtctatgcatctccagttggtaactacttcaaggaagggatggctgctcttaacctctatgttgaggaagaatatgtccgagcggctcctggtggagctggaggcgtcaagagcatcacaaattatgcgccagttttgaaagcactgagcagagccaagagtcgggggttttcagacgttctttatctcgactctgtcaagaagaagtacttagaggaggcttcttcttgcaacgtctttgttgtcaagggtcggacaatctcaactcctgcaactaatggaacaattcttgaagggattacgcggaaaagtgtgatggagatcgcaagtgatcaaggttatcaggtagtagagaaggcagttcatgtggatgaagtaatggatgcagatgaagttttttgcaccggaactgctgtagtagttgctcccgtgggcactatcacatatcaggaaaaaagagtagagtataaaaccggggatgaatctgtctgccagaaactgcgttcagtcctcgtaggtatccagacaggattgattgaagataacaagggatgggtcacagatatcaactag

SEQ ID NO: 88 - protein, 388 aa, Arabidopsis thaliana
  Branched-chain amino acid transaminase [Arabidopsis thaliana].
MIKTITSLRKTLVLPLHLHIRTLQTFAKYNAQAASALREERKKPLYQNGDDVYADLDWDNLGFGLNPADYMYVMKCSKDGEFTQGELSPYGNIQLSPSAGVLNYGQAIYEGTKAYRKENGKLLLFRPDHNAIRMKLGAERMLMPSPSVDQFVNAVKQTALANKRWVPPAGKGTLYIRPLLMGSGPILGLGPAPEYTFIVYASPVGNYFKEGMAALNLYVEEEYVRAAPGGAGGVKSITNYAPVLKALSRAKSRGFSDVLYLDSVKKKYLEEASSCNVFVVKGRTISTPATNGTILEGITRKSVMEIASDQGYQVVEKAVHVDEVMDADEVFCTGTAVVVAPVGTITYQEKRVEYKTGDESVCQKLRSVLVGIQTGLIEDNKGWVTDIN

SEQ ID NO: 89 - DNA, 879 bp, Arabidopsis thaliana
  Coding sequence of SEQ ID NO: 90.
atggcgggtcttcaagcgaagacgttaatgttcgttctggcagctgccttagcgactcttggtcgcacatttgtggaggcagacttcagtaagaattttattgttacatggggtaaagatcacatgttcatgaatggtaccaaccttcgacttgtcctagacaaatctgcaggatctgctattaaatcaaaggtggctcatttgtttggaagcgtagaaatgctcatcaaacttgtgccagggaattctgctggaaccgttgcagcctattacttatcgtctacgggaagtacacacgatgagatagacttcgagttcctaggaaatgcgactggtcagccgtacacgatccacaccaacttatatgctcaagggaaaggaaaccgcgaacaacaattccggccatggttcaacccgaccaatggtttccacaactataccatccattggaacccatccgaagttgtgtggttcgtcgatggaactccgatcagagtttttagaaactacgaaagtgaaggaatcgcatacccgaacaagcaaggtatgaaagtgtttgcgagtctatggaacgcagaagactgggcaacacaaggaggtcgagtgaagactaactggacgctagcaccatttgtggccgagggtcgtaggtacaaggcaagagcttgtttgtggaagggatcagtcagcatcaagcaatgtgtagatccaactatacggtctaattggtggacatcaccatcatttagtcagctcactgcttcgcagctgacgaagatgcaaaagataagagatggtttcatgatctatgattattgcaaggacactaacagatttaaaggtgttatgcctccggaatgctcgaagaagcaattctag

SEQ ID NO: 90 - protein, 292 aa, Arabidopsis thaliana
  xyloglucan endotransglycosylase-like protein [Arabidopsis thaliana].
MAGLQAKTLMFVLAAALATLGRTFVEADFSKNFIVTWGKDHMFMNGTNLRLVLDKSAGSAIKSKVAHLFGSVEMLIKLVPGNSAGTVAAYYLSSTGSTHDEIDFEFLGNATGQPYTIHTNLYAQGKGNREQQFRPWFNPTNGFHNYTIHWNPSEVVWFVDGTPIRVFRNYESEGIAYPNKQGMKVFASLWNAEDWATQGGRVKTNWTLAPFVAEGRRYKARACLWKGSVSIKQCVDPTIRSNWWTSPSFSQLTASQLTKMQKIRDGFMIYDYCKDTNRFKGVMPPECSKKQF

SEQ ID NO: 91 - DNA, 528 bp, Arabidopsis thaliana
  Coding sequence of SEQ ID NO: 92.
atgggcgtaagtggcgcagggaaatctaccataggtaaaatgttggggaaagctctatcttgcgattttcttgatgctgatgattttcattctttatcaaacagagataagatgcgtcaaggcattgctctttcagatgaagaccgaatgccatggcttgaaaaaatacaagagagtttgcgaaaacgtttactcgatggagaaaccgttgttctcgcatgttcttctttgagaaaacagtatagagaaatcttgagaggttctgatcctgattacaaaccgggaagctatacgagttgcaaggttacgtttgttttattggaaggtaatgcagaggtgattgctgctcggttacagaagagagcttccgaggaagaacatttcatgcctcttactcttcttcagtctcagtttgatctgcttcaagctgatgaatgtgaaaagatattcaaaatcagtgtggttctaagccctgaagttatagtcaatacaattcttgaaatggtagcaaattctttgaacccttag

SEQ ID NO: 92 - protein, 175 aa, Arabidopsis thaliana
  Gluconokinase [Arabidopsis thaliana].
MGVSGAGKSTIGKMLGKALSCDFLDADDFHSLSNRDKMRQGIALSDEDRMPWLEKIQESLRKRLLDGETVVLACSSLRKQYREILRGSDPDYKPGSYTSCKVTFVLLEGNAEVIAARLQKRASEEEHFMPLTLLQSQFDLLQADECEKIFKISVVLSPEVIVNTILEMVANSLNP

SEQ ID NO: 93 - DNA, 582 bp, Arabidopsis thaliana
  Coding sequence of SEQ ID NO: 94.
atgaattctcaccagaatcaaaccggagtgcaaaagaagggaataacggagaaaatcatggagaagctaccaggtcatcatggacctactaacactggtgttgttcaccacgagaagaaagggatgacggagaaagttatggagcagctgccaggtcatcatggtgctactggtaccggtggtgttcaccacgagaagaaaggaatgacggaaaaagttatggagcagctgccaggtcatcatggatcacaccaaactggaaccaacacaacttatggtactactaacactggtggtgttcaccacgagaaaaaaagtgtgaccgaaaaagttatggagaaactaccaggtcatcatgggtcacatcaaactgggactaacacggcttatggtactaacactaatgtcgttcaccatgagaaaaaaggtatagcagaaaagattaaagagcaactgccaggtcatcatggaactcacaaaactggaaccaccacaagttatggtaatactggcgttgttcaccatgaaaataaaagtacgatggataagattaaagagaagcttcccggtggtcatcactag

SEQ ID NO: 94 - protein, 193 aa, Arabidopsis thaliana
  Dehydrin Xero2 [Arabidopsis thaliana].
MNSHQNQTGVQKKGITEKIMEKLPGHHGPTNTGVVHHEKKGMTEKVMEQLPGHHGATGTGGVHHEKKGMTEKVMEQLPGHHGSHQTGTNTTYGTTNTGGVHHEKKSVTEKVMEKLPGHHGSHQTGTNTAYGTNTNVVHHEKKGIAEKIKEQLPGHHGTHKTGTTTSYGNTGVVHHENKSTMDKIKEKLPGGHH

SEQ ID NO: 95 - DNA, 447 bp, Arabidopsis thaliana
  Coding sequence of SEQ ID NO: 96.
atggcttccactgctctctcaagcgccatcgtcggaacttcattcatccgtcgttccccagctccaatcagtctccgttcccttccatcagccaacacacaatccctcttcggtctcaaatcaggcaccgctcgtggtggacgtgtcacagccatggctacatacaaggtcaagttcatcacaccagaaggtgagctagaggttgagtgtgacgacgacgtctacgttcttgatgctgctgaggaagctggaatcgatttgccttactcttgccgtgctggttcttgttcgagctgtgctggtaaagttgtgtctggatctgttgatcagtctgaccagagtttccttgatgatgaacagattggtgaagggtttgttctcacttgtgctgcttaccctacctctgatgttaccattgaaacccacaaagaagaagacattgtttag

SEQ ID NO: 96 - protein, 148 aa, Arabidopsis thaliana
  Ferrodoxin precursor [Arabidopsis thaliana].
MASTALSSAIVGTSFIRRSPAPISLRSLPSANTQSLFGLKSGTARGGRVTAMATYKVKFITPEGELEVECDDDVYVLDAAEEAGIDLPYSCRAGSCSSCAGKVVSGSVDQSDQSFLDDEQIGEGFVLTCAAYPTSDVTIETHKEEDIV

SEQ ID NO: 97 - protein, 682 aa, Zea mays
  Zm PI3_PI4_kinase.
MICDKCSLVRSFFVGRPRDITSLYKKAGSCRTMSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDGEDDYPDALEPSAFCKFGSMKASSRNPLSKLDERDEEDGDGTEEDDDDDILTGALPQRISSISKLSSSMKGLGFIGKPKPYRTCLRKGKATGRTKYTGKASEHQSGSRSANELLPPSASFVKLSDMSPKQWSAFLDKFQELLPGALSARKHAAGVVGQRSMPRLGTSCQF

SEQ ID NO: 98 - protein, 69 aa, Yersinia pestis
  Cold shock-like protein CspC.
MAKIKGQVKWFNESKGFGFITPADGSKDVFVHFSAIQGNGFKTLAEGQNVEFEIQDGQKGPSAVNVTAI

SEQ ID NO: 99 - protein, 69 aa, Shigella flexneri
  Cold shock-like protein CspC.
MAKIKGQVKWFNESKGFGFITPADGSKDVFVHFSAIQGNGLKTLAEGQNVEFEIQDGQKGPAAVNVTAI

SEQ ID NO: 100 - protein, 69 aa, Pectobacterium atrosepticum
  Cold shock-like protein CspC.
MAKIKGQVKWFNESKGFGFITPADGSKDVFVHFSAIQGNGFKTLAEGQNVEFEIQDGQKGPSAVNVTAL

SEQ ID NO: 101 - protein, 69 aa, Escherichia coli
  Cold shock-like protein CspC.
MAKIKGQVKWFNESKGFGFITPADGSKDVFVHFSAIQGNGFKTLAEGQNVEFEIQDSQKGPAAVNVTAI

SEQ ID NO: 102 - protein, 69 aa, Salmonella enterica
  Cold shock-like protein CspC.
MAKIKGQGKWFNESKGFGFITPADGSKDVFVHFSAIQGNGFKTLAEGQNVEFEIQDGQKGPAAVNVTAI

SEQ ID NO: 103 - protein, 141 aa, Arabidopsis thaliana
  Putative auxin-induced protein.
MMINAKKLMKLAKKWQQRAALKRKRISFQRSSITTSSQTAVEKGCFVVYTADKIRFSFPLSYLSNTIIQELLKISEEEFGLPTEGPITLPFDSAFLEYLINLIQRRMDEDTEKALLLSISSARSSFQPQQHCSATQQLLVF

SEQ ID NO: 104 - protein, 141 aa, Arabidopsis thaliana
MMINPKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 105 - protein, 140 aa, Arabidopsis thaliana
  Auxin-induced protein, putative [Arabidopsis thaliana].
MINPKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 106 - protein, 687 aa, Arabidopsis lyrata
  Hypothetical protein.
MELESTSNGRRPPPPAEIGRGAYLAWEDLTVVIPNFSGGPTRRLLDGLNGHAEPGRIMAIMGPSGSGKSTLLDSLAGRLARNVIMTGNLLLNGKKARLDYGLVAYVTQEDILMGTLTVRETITYSAHLRLSSDLTKEEVNDIVEGTIIELGLQDCADRVIGNWHSRGVSGGERKRVSVALEILTRPQILFLDEPTSGLDSASAFFVIQALRNIARDGRRTVVSSIHQPSSEVFALFDDLFLLSSGETVYFGESKFAVEFFAEAGFPCPKKRNPSDHFLRCINSDFDTVTATLKGSQRIRETPATSDPLMNLATSEIKARLVENYRRSIYAKSAKSRIRELASIEGHHGMEVRKGSEATWFKQLSTLTKRSFVNMTRDIGYYWSRIVIYIVVSFCVGTIFYDVGHSYTSILARVSCGGFITGFMTFMSIGGFPSFIEEMKVFYKERLSGYYGVSVYIISNYVSSFPFLVAIALITGSITYNMVKFRPGVSHWAFFCLNIFFSVSVIESLMMVVASLVPNFLMGLITGAGIIGIIMMTSGFFRLLPDLPKVFWRYPISFMSYGSWAIQGAYKNDFLGLEFDPMFAGEPKMTGEQVINKIFGVQVTHSKWWDLSAIVLILVCYRILFFIVLKLKERAEPALKAIQAKRTMKTLKKRPSFKKVPSLSSLSSRRHQPLHSLSSQEGLTSPIN

SEQ ID NO: 107 - protein, 108 aa, Arabidopsis lyrata
  NADH-ubiquinone oxidoreductase 19 kDa subunit family protein.
MEANAAVDGTGNPIPTSAVLTASAKHIGIRCMPENMAFLKCKKNDPNPEKCLEKGRDVTRCVLGLLKDLHQRCPKEMDAYVGCMYYYTNEFDLCRKEQEVFEKACPLK

SEQ ID NO: 108 - protein, 334 aa, Arabidopsis thaliana
  Putative protein [Arabidopsis thaliana].
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 109 - protein, 336 aa, Arabidopsis lyrata
  ARF-GAP domain 13 [Arabidopsis].
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFVPDTCSKPGPDVSHDQRMRFIRAKYELQEFLKPSLRITSGKCSTKSSAFLTSSLSRKIMDSFRTNSSSQKIFQEGMVEFIGLLKVTIKKGTNLAIRDMMSSDPYVVLNLGKQKLQTTVVNSNLNPVWNQELMLSVPESYGPVKLQVYDYDTFSADDIMGEAEIDIQPLITSAMAFGDPEMFGDMQIGKWLKSHDNPLIDDSIINIVDGKVKQEVQIKLQNVESGELELEMEWLPLDQ

SEQ ID NO: 110 - protein, 116 aa, Arabidopsis lyrata
  Hypothetical protein.
MASSAPQGSADPLTGKDPAKALTAVASGFFENVKKNKQSFFQFFAMTGILLLSFRSVSQKYRIHDLEEDTAVLKKEQDSLTDRMSKIKSDLLHQASIDSTGVFASRLRLLFGDDKK

SEQ ID NO: 111 - protein, 540 aa, Anabaena variabilis
  Bifunctional GMP synthase/glutamine amidotransferase protein.
MNTAVTLLTEQAPQPIEEFGQLERQIIIILDFGSQYSELIARRIRETQVYSEVLSYRTSAEHLRQLNPKGIILSGGPSSVYSDRAPHCDPEIWNLGVPILGVCYGMQLMVNQLGGEVAKADRGEYGKASLHIDDPTDLLTNVEDGTTMWMSHGDSVTKMPPGFEVLAHTDNTPCAAVADHDKKLYGVQFHPEVVHSIGGLALIRNFVYHICECEPTWTTAAFVEEAIREVRAKVGDKRVLLALSGGVDSSTLAFLMHKAIGDQLTCVFIDQGFMRKYEPERLVKLFQEQFHIPVEYVNARDRFLDIMVGVTDPEEKRRRIGHEFIQVFEETSRNLGPFDYLAQGTLYPDVIESADTNVDPQTGERVAVKIKSHHNVGGLPKDLRFKLVEPLRKLFKDEVRKVGRSVGLPEEIVQRQPFPGPGLAIRILGEVTADRLNILRDADLIVRQEINQRGLYNEYWQAFAVLLPIRSVGVMGDQRTYAYPIVLRIVKSEDGMTADWARVPYDVLEAISNRIVNEVKGVNRVVFDITSKPPGTIEWE

SEQ ID NO: 112 - protein, 346 aa, Zea mays
  Hypothetical protein LOC100191339 [Zea mays].
MENMLHLAPSSQAQALALDRSSVFSREHVPPAVSAVTSLPVIDMSRSRDEVRRAILDAGMEFGFFLVVEHGIPEEVMRDMLEVCEEFFQLPAASKAYMYSEDSQRPNRIFSGTTYDTGGDKYWRDCLRLACPSSFPVGSGTRDDWPHTPQRLRGVVERFTALTRGLGVELLRLLFEAMGIRPDYFEGDISAGDVVLNVNHYPPCPSPEKTLGLPPHCDRNLITLLLQGSVYGLDVAYRGEWIKVEPMPGALVVNFGQQLEVVTNGLLKSVEHRVVTSSTLARTAVATFIMPTPDCLIGPSKEFLAGDKPPCYRTIRFGDFMRMYNTVKLGSSINQTTDLKNIQKKI

SEQ ID NO: 113 - protein, 393 aa, Arabidopsis thaliana
MFCDSFAFAQVMSCFGCFGGSERSRHSPNPYDDDTYSHDSGETSNPGGDDEEGEEEEEVEELSRSKRSEEILKCKLQNGLVCRQFPVKETNKLTRGEDEDGNKTINEFVRERKIGSGSYGKVVLYRSTVDDKHYAIKAFHKSHLSRLRVAPSETAMGDVLREVMIMKTLEHPNIVNLIEVIDDPEFDDFYMVLEYVDGKWAYDDSGPPGALGEITARKYLRDVVAGLMYLHAHNVIHGDIKPDNLLVTSTGRVKIGDFSVSQDDDDQLRRSPGTPVFTAPECCLGITYSGRSADTWAVGVTLYCMILGQYPFLGDTLQDTYDKIVHNPLIIPEGLNPRLRDLIEGLLCKDPNQRMTLKAVAEHPWITGEDGAISEYCCWCKRKAEEEEDQNHS

SEQ ID NO: 114 - protein, 382 aa, Arabidopsis thaliana
  Serine/threonine-protein kinase-like protein [Arabidopsis thaliana].
MSCFGCFGGSERSRHSPNPYDDDTYSHDSGETSNPGGDDEEGEEEEEVEELSRSKRSEEILKCKLQNGLVCRQFPVKETNKLTRGEDEDGNKTINEFVRERKIGSGSYGKVVLYRSTVDDKHYAIKAFHKSHLSRLRVAPSETAMGDVLREVMIMKTLEHPNIVNLIEVIDDPEFDDFYMVLEYVDGKWAYDDSGPPGALGEITARKYLRDVVAGLMYLHAHNVIHGDIKPDNLLVTSTGRVKIGDFSVSQDDDDQLRRSPGTPVFTAPECCLGITYSGRSADTWAVGVTLYCMILGQYPFLGDTLQDTYDKIVHNPLIIPEGLNPRLRDLIEGLLCKDPNQRMTLKAVAEHPWITGEDGAISEYCCWCKRKAEEEEDQNHS

SEQ ID NO: 115 - protein, 512 aa, Escherichia coli
  Respiratory nitrate reductase 1 beta chain.
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTICSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 116 - protein, 512 aa, Shigella flexneri
  Nitrate reductase 1, beta subunit.
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPILRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 117 - protein, 512 aa, Escherichia coli
  Nitrate reductase 1, beta subunit.
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLEVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 118 - protein, 509 aa, Escherichia coli
  gi|290560092|pdb|3EGW|B Chain B, The Crystal Structure Of The Narghi Mutant Narh - C16a.
MKIRSQVGMVLNLDKAIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTE

SEQ ID NO: 119 - protein, 416 aa, Arabidopsis thaliana
  RCY1.
MIYTAIDNFYLTDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 120 - protein, 416 aa, Arabidopsis thaliana
  RCY1 (ARGININE-RICH CYCLIN 1); cyclin-dependent protein kinase regulator [Arabidopsis thaliana].
MIYTAIDNFYLSDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 121 - protein, 423 aa, Arabidopsis thaliana
PLLFSESMIYTAIDNFYLSDEQLKASPSRKDGIDETTEISLRIYGCDLIQEGGILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 122 - protein, 416 aa, Arabidopsis thaliana
  Putative cyclin.
MIYTAIDNFYLSDEQLKASPSRKDGIDETTEISLRIYGCDLIQEGEILLKLPQAVMATGQVLFQRFYCKKSLAKFDVKIVAASCVWLASKLEENPKKARQVIIVFHRMECRRENLPLEHLDMYAKKFSELKVELSRTERHILKEMGFVCHVEHPHKFISNYLATLETPPELRQEAWNLANDSLRTTLCVRFRSEVVACGVVYAAARRFQVPLPENPPWWKAFDADKSSIDEVCRVLAHLYSLPKAQYISVCKDGKPFTFSSRSGNSQGQSATKDLLPGAGEAVDTKCTAGSANNDLKDGMVTTPHEKATDSKKSGTESNSQPIVGDSSYERSKVGDRERESDREKERGRERDRGRSHRGRDSDRDSDRERDKLKDRSHHRSRDRLKDSGGHSDKSRHHSSRDRDYRDSSKDRRRHH

SEQ ID NO: 123 - protein, 411 aa, Physcomitrella patens
  gi|168012238|ref|XP_001758809.1| predicted protein [Physcomitrella patens subsp. patens] gi|162689946|gb|EDQ76315.1| predicted protein [Physcomitrella patens subsp. patens].
MAASAASTALTVSGSTSLDMSTLSSKSAFGSSCSAMQAAPVSRRAVRSGVVMASVGSEEAKPARREVLAGILAAGAALGFSGQANAAMNPVAAAKSKAGQAVQGAKDLAGSNPLEGVVGSNPLGDAQSTVEEAASGIKGRIDGLFGKDKPYPKRNTQVTGKGPVADAKARVGNFLDNSQNPLATNIEKAAKEAESGLAVATGPNSPSARAGKEFLGQDSTRVDEATVRVNAGAEKLQGKAVQAVDDVKSAVGAAKDAAPDVKVEAPGSGLLKSFGSKVDAVKGNVASMAEDAKSTAGGAASNVLGQIGEVMGGGCFAHGQLIPCHRGTSMLWELLLFLLEVNCTKIYLRSHRSIVRLEGLGVAQIEFGFHKFLKIGTYDMINIVRSQNFNRSQFDWDFCPETFAFQRRPAI

SEQ ID NO: 124 - protein, 404 aa, Arabidopsis thaliana
  Mevalonate diphosphate decarboxylase [Arabidopsis thaliana].
MVTAQTPTNIAVIKYWGKRDEVRILPINDSISVTLDPDHLCTLTTVAVSPSFDRDRMWLNGKEISLSGSRYQNCLREIRSRADDVEDKEKGIKIAKKDWEKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSRQKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVMIARNRKVAVELLQGLLYCFPPKPDTDMKSYVLGDTSIVKEAGLEGELPQGIKDKIGSQDQKGEVSYFICSRPGRGPVVLQDQTQALLHPQTGLPK

SEQ ID NO: 125 - protein, 349 aa, Arabidopsis lyrata
  Short-chain dehydrogenase/reductase family protein [Arabidopsis lyrata subsp. lyrata].
MELINDFLNLTAPFFTFFGLCFFLPPFYFFKFLQSIFSTIFLENLYGKVVLITGASSGIGEQLAYEYACRGACLALTARRKNRLEEVAEIARELGSPNVVTVHADVSKPDDCRRIVDDTITHFGRLDHLVNNAGMTQISMFENIEDITRTKAVLDTNFWGSVYTTRAALPYLRQSNGKIVAMSSSAAWLTAPRMSFYNASKAALLSFFETMRIELGGDVHITIVTPGYIESELTQGKYFSGEGELIVNQDMRDVQIGPFPVSSASGCAKAIVNGVCRKQRYVTVPSWFKVTYLWKVLCPELIEWGCRLLYMTGTGMSEESALNKRIMDIPGVRSALYPESIRRPEIKSD

SEQ ID NO: 126 - protein, 294 aa, Zea mays
  Fruit protein PKIWI502 [Zea mays].
  unsure (1)..(294): unsure at all Xaa locations
MAAVSAAPRPSMPPRLALRAHLFXXAXPXPMRALPLLRSRFRSLTTAYAVKQDTALWTPAPVSAISAATDDXSVSLIAVDLSDATDLVDSYTNPGQYLLIRVPGEELKPAYMVISSPPKAGPRFEFLVKSVPGATAGRLCALRDGDVVELGAVTGKGFPLDRINPPDVAQTVLIFAAGTGISAIRSLIEFGFAAKERADVRLYYGDTSLKSMSYQERLSNWESTGIKIIPVLSQPDDSWKGERGYVQDAFFRNKNIVNPSSTGAILCGPNEMQEELTLSLVADGVSRDKILTNY

SEQ ID NO: 127 - protein, 325 aa, Zea mays
  Probable membrane-associated 30 kDa protein, chloroplast precursor.
MEIRAPPTSLSLAPPPASASFRRTPLRTFFLNGSVSLKVVQVRQSNVNRFKCNSIQSNLFDRLTRVARSYANAVLSSFEDPEKILEQAVLEMNDDLTKMRQATAQVLASQKRLENKYKAAEQASADWYRRAQLALQKGDEDLAREALKRRKSYADNASSLRSQLDQQKGVVENLISNTRVLESKIAEAKQKKDTLKARAQSAKQMWILFHFRTATKVSEMLGNVNTSSALSAFEKMEEKVMAMESQAEALGQLATDDLEGKFALLENSSVDDDLSQLKKELSGSSLKGELPSGRRAASNSGAGRPFPDLEIESELNELRRKAKEY

SEQ ID NO: 128 - protein, 316 aa, Zea mays
  gi|212274505|ref|NP_001130281.1| hypothetical protein LOC100191375 [Zea mays].
MEIRAPPTSLRLAPPPAAASFRRTPLRTSFLRGSVSLKVVQVRQSNVNRFKCNSIRSNLFDRLTRVVRSYANAVLSSFEDPEKILDQAVLEMNDDLTKMRQATAQVLASQKRLENKYKAAEQASADWYRRAQLALQKGDEDLAREALKRRKSYADNASSLRSQLDQQKGVVENLISNTRLLESKIAEAKQKKDTLKARAQSAKTATKVSEMLGNVNTSSALSAFEKMEEKVMAMESQAEALGQLATDDLEGKFALLETSSVDDDLSQLKKELSGSSLKGELPPGRTAVSNSGAGRPFPDLEIESELNELRRKAKEY

SEQ ID NO: 129 - protein, 316 aa, Zea mays
  Membrane-associated 30 kDa protein [Zea mays].
MEIRAPPTSLRLAPPPASASFRRTPLRTSFLRGSVSLKVVQVRQSNVNRFKCNSIRSNLFDRLTRVVRSYANAVLSSFEDPEKILDQAVLEMNDDLTKMRQATAQVLASQKRLENKSKAAEQASADWYRRAQLALQKGDEDLAREALKRRKSYADNASSLRSQLDQQKGVVENLISNTRLLESKISEAKQKKDTLKARAQSAKTATKVSEMLGNVNTSSALSAFEKMEEKVMAMESQAEALGQLATDDLEGKFALLETSSVDDDLSQLKKELSGSSLKGELPPGRTAVSNSGAGRPFPDLEIESELNELRRKAKEY

SEQ ID NO: 130 - protein, 316 aa, Sorghum bicolor
  gi|242055261|ref|XP_002456776.1| hypothetical protein SORBIDRAFT_03g042550 [Sorghum bicolor].
MEIRAQPTSLRLAPPPASASFRRTPLRTSFLKGNVSLKVVQVRQSNVNRFKCNSIRSNLFERLTRVVRSYANSVLSSFEDPEKILEQAVLEMNDDLTKMRQATAQVLASQKRLENKYKAAEQASADWYRRAQLALQKGDEDLAREALKRRKSYADNASSLRSQLDQQKGVVENLISNTKVLESKIAEAKQKKDTLKARAQSAKTATKVSEMLGNVNTSSALSAFEKMEEKVMAMESQAEALGQLATDDLEGKFALLETSSVDDDLSQLKKELSGSSLKGELPPGRAAVSNSGAGRPFPDLEIESELNELRRKAKEY

SEQ ID NO: 131 - protein, 431 aa, Arabidopsis thaliana
  gi|21554890|gb|AAM63721.1| unknown [Arabidopsis thaliana].
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTERADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLVLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVVMAIMGLCLASFWGNGFRIRDVLSLSTPQSRGYTTES

SEQ ID NO: 132 - protein, 431 aa, Arabidopsis thaliana
  unsure (1)..(431): unsure at all Xaa locations
MTLIASLSLPPPAIQRQSLSEFHNLPAKSQSFNCQFRSSSSPLSSLHSSSLSNFLDFRLRRRNSGLVPVVACSTTPFMGRVGLHWRDGNMSLLSFCGGTDVTERADSSQFWSALLPFVVALTAVAALSYPPSFTWVSKDLYAPALGGIMLSIGIQLSVDDFALAFKRPVPLSVGFVAQYVLKPLLGVLVANAFGMPRTFYAGFILTCCVAGAQLSSYASSLSKADVAMSILLTSSTTIASVIFTPLLSGLLIGSVVPVDAVAMSKSILQVVLVPITLGLXLNTYAKPVVTLLQPVMPFVAMVCTSLCIGSPLSINRSQILSAEGLGLIVPIVTFHAVAFALGYWFSKIPGLRQEEEVSRTISLCTGMQSSTLAGLLASQFLGSSQAVPAACSVVVMAIMGLCLASFWGNGFRIRDVLSLSTPQSRGYTTES

SEQ ID NO: 133 - protein, 412 aa, Arabidopsis lyrata
  gi|297827457|ref|XP_002881611.1| hypothetical protein ARALYDRAFT_482881 [Arabidopsis lyrata subsp. lyrata].
MAEEKWVMMVTAQTPTNIAVIKYWGKRDEVRILPINDSISVTLDPDHLCTLTTVSVSPSFDRDRMWLNGKEISLSGSRYQNCLREIRSRADDLEDKEKGIKIEKKDWQKLHLHIASHNNFPTAAGLASSAAGFACLVFALAKLMNVNEDPSQLSAIARQGSGSACRSLFGGFVKWNMGNKEDGSDSVAVQLVDDKHWDDLVIIIAVVSSREKETSSTSGMRESVETSLLLQHRAKEVVPVRILQMEEAIKNRDFTSFTKLTCSDSNQFHAVCMDTSPPIFYMNDTSHRIISLVEKWNRSAGTPEIAYTFDAGPNAVLIARNRKVAVELMQGLLYCFPPKPDTDMKSYVLGDTSIVKEAGLEGELPQGIKDKIGNQDQKGEVSYFICSRPGRGPVVLQDQTQALLHPQTGLPK

SEQ ID NO: 134 - protein, 1180 aa, Saccharomyces cerevisiae
  Pyruvate carboxylase [Saccharomyces cerevisiae YJM789].
MSSSKKLAGLRDNFSLLGEKNKILVANRGEIPIRIFRSAHELSMRTIAIYSHEDRLSMHRLKADEAYVIGEEGQYTPVGAYLAMDEIIEIAKKHKVDFIHPGYGFLSENSEFADKVVKAGITWIGPPAEVIDSVGDKVSARHLAARANVPTVPGTPGPIETVQEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKVCGYRNAGTAEFLVDNQNRHYFIEINPRIQVEHTITEEITGIDIVSAQIQIAAGATLTQLGLLQDKITTRGFSIQCRITTEDPSKNFQPDTGRLEVYRSAGGNGVRLDGGNAYAGATISPHYDSMLVKCSCSGSTYEIVRRKMIRALIEFRIRGVKTNIPFLLTLLTNPVFIEGTYWTTFIDDTPQLFQMVSSQNRAQKLLHYLADLAVNGSSIKGQIGLPKLKSNPSVPHLHDAQGNVINVTKSAPPSGWRQVLLEKGPSEFAKQVRQFNGTLLMDTTWRDAHQSLLATRVRTHDLATIAPTTAHALAGAFALECWGGATFDVAMRFLHEDPWERLRKLRSLVPNIPFQMLLRGANGVAYSSLPDNAIDHFVKQAKDNGVDIFRVFDALNDLEQLKVGVNAVKKAGGVVEATVCYSGDMLQPGKKYNLDYYLEVVEKIVQMGTHILGIKDMAGTMKPAAAKLLIGSLRTRYPDLPIHVHSHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDIRRLANSLDFPDSVMDFFEGLIGQPYGGFPEPLRSDVLRNKRRKLTCRPGLELEPFDLEKIREDLQNRFGDIDECDVASYNMYPRVYEDFQKIRETYGDLSVLPTKNFLAPAEPDEEIEVTIEQGKTLIIKLQAVGDLNKKTGQREVYFELNGELRKIRVVDKSQNIQSVAKPKADVHDTHQIGAPMAGVIIEVKVHKGSLVKKGESIAVLSAMKMEMVVSSPADGQVKDVFIKDGESVDASDLLVVLEEETLPPSQKK

SEQ ID NO: 135 - protein, 315 aa, Zea mays
  i|219887289|gb|ACL54019.1| unknown [Zea mays].
MAASCASTLPPLSFVSSSSSPRRFRRSGVVAMASVGQKVYAPGVAVSEGNGGLPKIDLKSPHGSEAEIYLFGACVTSFKVPNGKDLLFVRPDAVFNGQKPISGGIPHCFPQFGPGPMQQHGFARNVNWSITDSEVTEGDPAVTLELKDDTYSRSMWDFSFHALYKVSLHSKSLSTTLAIINTDDKPFSFNSALHTYFSASITGVSVKGLKGCKTLNKDPDPKNPLEGKEEREEVTFPGFVDCVYLGAPSELILDNGLGDKIAIANSNWSDAVLWNPHLQMEACYKDFVCVENAKIEMVQLEPKQSWVAEQKIELV

SEQ ID NO: 136 - protein, 387 aa, Zea mays
  Hypothetical protein.
MAAVAAHHHLHPSSVAARTPTLGRRHRFSSLPLAARPSSQGRFSSRAATRVLTRAGSTGASSAASPAATTASSLSLEELRGGCTTWTWRGMRVNYLARGQGPPVLLVHGFGASVAHWRRNIGVLSESYTVYAIDLLGFGASDKPPGFSYTMETWAELILDFLEEVVRRPTVLVGNSVGSLACVIAASESSREAVRGLVLLNCAGGMNNKAIVDDWRIKLLLPLLWLIDFLLKQRPIASALFNRVKNRDNLKDILLSVYGNKDAVDDELVEIIRGPADTEGALDAFVSTVTGPPGPSPIALMPRLADLPVLVLWGDRDPFTPIDGPVGKFFSKLPSELPNVTLYMLEGVGHCPHDDRPDLVHDRLLPWLEALLPPAAGAVTTTTTTVV

SEQ ID NO: 137 - protein, 385 aa, Zea mays
  Alpha/beta hydrolase fold [Zea mays].
MAALAAHHHLHPSSVAARTPTLGRRHRFSSLPLAARPSSQGRFSSRAATRVLTRAGSTGASSAASPAATTASSLSLEELRGGCATWTWRGMRVNYLARGQGPPVLLVHGFGASVAHWRRNIGVLSESYTVYAIDLLGFGASDKPPGFSYTMETWAELILDFLEEVVRRPTVLVGNSVGSLACVIAASESSREAVRGLVLLNCAGGMNNKAIVDDWRIKLLLPLLWLIDFLLKQRPIASALFNRVKNRDNLKDILLSVYGNKDAMDDELVEIIRGPADTEGALDAFVSTVTGPPGPSPIGLMPRLADLPVLVLWGDRDPFTPIDGPVGKFFSKLPSELPNVTLYMLEGVGHCPHDDRPDLVHDKLLPWLEALPPPAAGAVTTTTVV

SEQ ID NO: 138 - protein, 340 aa, Zea mays
  Hypothetical protein.
MAEEMAQAQPRLTAPRSVRCIVKLGGAAITNKGELESINEENLRSACAQLRHAMSESDGDGAMEKVLGMDWSRKPGDPVNSAVDAEWIAGIARLGLDTNFVVVHGAGSFGHFQASRSGVHKGGLHSTLVKAGFVATRISVTSLNQEIVRALAREGIPSVGMSPFACGWSTQQRKLASANASQIIQSLHAGFVPVLHGDAVLDELLDCTILSGDVIIRHLAQLLSPKYVVFLTDVHGVYDRPPTDSNAVLLREIEVDDIGGWSIVKPALLQGNTKGVEISVAAHDTTGGMETKILEAAVIARLGIDVYITKAGTEHSLRALKGDVSTDSEDWLGTIIRSSK

SEQ ID NO: 139 - protein, 340 aa, Sorghum bicolor
  gi|242058797|ref|XP_002458544.1| hypothetical protein SORBIDRAFT_03g035480 [Sorghum bicolor].
MAEEVAQEQPRPTAPRPVRCIVKLGGAAITNKGELESINEENLRSACAQLRHAMSESDGDGATEKVLGMDWSRKPGDPADPAVDAEWIAGMAGLGLDTNFIVVHGAGSFGHFQASRSGVHKGGLHSTLVKAGFVATRISVTSLNQEIVRALAREGIPSVGMSPFACGWSTQQRKLASANASQIIQSLHTGFVPVLHGDAVLDELLDCTILSGDVIIRHLAQLLSPRYVVFLTDVHGVYDRPPTDPNAVLLKEIEVDDNGGWSIVKPALLQGNTKGVEISVAAHDTTGGMETKILEAAVIARLGIDVYITKAGTEHSLRALKGDVSTDSEDWLGTIIRSSK

SEQ ID NO: 140 - protein, 86 aa, Arabidopsis thaliana
  unsure (1)..(86): unsure at all Xaa locations
MSRGKLELSMICLREVRSVLSPLKSEWECLSLTLNVVGSIFLFLWFLEISDKLPKKXGCLRNKQPLRHQNWIFVNTLFSGDTVVET

SEQ ID NO: 141 - protein, 516 aa, Arabidopsis thaliana
MGSGQWHMEKRSTLKNDSFVKEYNPITETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 142 - protein, 516 aa, Arabidopsis thaliana
  gi|18086470|gb|AAL57688.1| AT3g27300/K17E12_12 [Arabidopsis thaliana].
MGSGQWHMEKRSTLKNDSFVKEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKGVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 143 - protein, 516 aa, Arabidopsis thaliana
  unsure (1)..(516): unsure at all Xaa locations
MGSGQWHMEKRSTLKNDSFVQEYNPVTETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAISEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNXHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDGEVKSVPYKQGSRGPAEADQLLKKAGYMQTHGYIWIPPTL

SEQ ID NO: 144 - protein, 521 aa, Arabidopsis lyrata
  Glucose-6-phosphate dehydrogenase 5 [Arabidopsis lyrata subsp. lyrata].
MGSGPSGEWHMEKRSTLKNDSFVKEYNPVSETGSLSIIVLGASGDLAKKKTFPALFHLYHQGFLNPDEVHIFGYARSKISDEDLRDKIRGYLVDERNASDKAEALSKFLKLIKYVSGPYDSEEGFKRLDEAISEHEISKRTSEGSSRRLFYLALPPSVYPPVSKMIKAWCTNKSDLGGWTRIVVEKPFGKDLESAEQLSSQIGALFDEPQIYRIDHYLGKELVQNMLVLRFANRLFLPLWNRDNIANVQIVFREDFGTEGRGGYFDEYGIIRDIIQNHLLQASVLCLVAMEKPISLKPEHIRDEKVKVLQSVIPIKDEEVVLGQYEGYRDDPTVPNDSNTPTFATTILRIDNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIKGDQQHFVRRDELKAAWEIFTPLLHRIDKGEVKSIPYKQGSRGPAEADQLLKKAGYTQTHGYIWIPPTL

SEQ ID NO: 145 - protein, 476 aa, Arabidopsis thaliana
  Alanine:glyoxylate aminotransferase 2 homolog [Arabidopsis thaliana].
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVQDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 146 - protein, 476 aa, Arabidopsis lyrata
  hypothetical protein ARALYDRAFT_490746 [Arabidopsis lyrata subsp.lyrata].
MALQRQLLKRASSGIYHRREISLLRADFSTSPSIADAPPQIPPFDYQPRPYKGPSADEVFQKRKKFLGPSLFHFYQKPLNIVEGKMQYLFDESGRRYLDAFAGIVTVSCGHCHPEILNAIVEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVKDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDLQKRHDIIGDVRGRGLMVGIELVSDRKDKTPAKAETAVLFEQLRELGILVGKGGLHGNVFRIKPPMCFTKDDADFLVNALDYSISRL

SEQ ID NO: 147 - protein, 507 aa, Zea mays
  G6PDH.
MSGGSSPSSRRNSFNSLSKDLDLPSEQGCLSIVVLGASGDLAKKKTFPALYHLFEQGFIQSGEVHIFGYARSNLSDDGLRERIRGYLKGAPEDLSEFLQLIKYVSGSYDTGEGFEKLNRAISEYEVSKSSGSYRRLFYLALPPSVYPSVCKMIRTYCMNPSSHPGWTRVIVEKPFGKDLDSAEELSAQLGELFEEHQLYRIDHYLGKELVQNLLVLRFANRLFLPLWNRDNIDNIQIVFREDFGTEGRGGYFDQYGIIRDIIQNHLLQVFCLVAMEKPVSLKPEHIRDEKVKVLQSVNPIKPEEVVLGQYDGYKDDPTVPDDSNTPTFASVVLRVHNERWEGVPFILKAGKALSSKKAEVRVQFKDVPGDIFRSKKQGRNEFVIRLQPSEAMYMKLTVKKPGLEMATEQSELDLSYGMRYQNVKIPEAYERLILDTIRGDQQHFVRRDELQAAWKIFTPLLHDIDDGKLKALPYEPGSRGPKEADELSARVGYVQTHGYIWVPPTLA

SEQ ID NO: 148 - protein, 594 aa, Sorghum bicolor
  gi|242073500|ref|XP_002446686.1| hypothetical protein SORBIDRAFT_06g020560 [Sorghum bicolor].
MEPPTGFWASLLSFLKFLPYFSGLLILGFIKGVLLCPWACLIMAIGISALVLGLWPMHLIWTYYCIIRTKLVGPVVKLLLLIAATAVLIIWLIIGIPGSVFAGLVYGFLAPIMATFDAVGEGKEKPFVHCFVDGTWSTITGSCTVVRDVKDLLFHSYFSIMDDLRLQKPPDGKPYEIRLLDIPGALIAAAFGLLLDGIMFTLIAFYKCPVMLFKGWKRLIQDMIGREGPFLETACVPFAGLAILLWPFAVVGAVLASILSSVPLGAYGAVVAYQESSFVMGLAYVFSSVSIFDEYTNDVLDMAPGSCFPRFKYRKGKGESSHGHSAPLSRPASFDREKQEGKKPPSRVTSFKNSIDEFNPFKLLDHLFAECRNQGEALVNKGVITMKDIEETKSGKVGSGVLNVGLPAYVILNALLRSAKADSVGLILSDGSEITSDNRPKSTIFDWFFDPLMVIKEQIKAENLSEEEEEYLKMRVLLAGDPSRLKGSLPHVPSLTERKKADIDAFARRLQGITKSISRYPTAKRRFDILVKALLSELERTMGGSSQSANGSQSQAQRLRNSVARMLSQKSMGKTANIRDEDPEAQMTRLSRTP

SEQ ID NO: 149 - protein, 388 aa, Arabidopsis lyrata
  ATBCAT-2 [Arabidopsis lyrata subsp. lyrata].
MIKAISSLRKTLVLPLHLHIRTLQTFAKYNAQAASALREERKTPLYQNGDDEYVDLDWDNLGFGLTPADYMYVMKCSKVGEFTQGELSPYGNIQLSPSAGVLNYGQAIYEGTKAYRKENGKLLLFRPDHNALRMKLGAERMLMPSPSVDQFVNAIKQTALANKRWVPPSGKGTLYIRPLLMGSGPILGLGPAPEYTFIVYASPVGNYFKEGMAALNLYVEEEYVRAAPGGAGGVKSITNYAPVLKALSRAKSQGFSDVLYLDSVKKKYLEEASSCNVFVVKGRTISTPATNGTILEGITRKSVMEIASDQGYQVVEKAVHVDEVMDADEVFCTGTAVVVAPVGTITYQDKRVEYKTRDESVCQKLRSVLVGIQTGLIEDNKGWVTNIN

SEQ ID NO: 150 - protein, 189 aa, Arabidopsis thaliana
  Putative gluconokinase [Arabidopsis thaliana].
MSAKNDVTGKVIVIMGVSGAGKSTIGKMLGKALSCDFLDADDFHSLSNRDKMRQGIALSDEDRMPWLEKIQESLRKRLLDVETVVLACSSLRKQYREILRGSDPDYKPGSYTSCKVTFVLLEGNAEVIAARLQKRASEEEHFMPLTLLQSQFDLLQADECEKIFKISVVLSPEVIVNTILEMVANSLNP

SEQ ID NO: 151 - protein, 189 aa, Arabidopsis thaliana
  unsure (1)..(189): unsure at all Xaa locations
MSAKNDVTGKVIVIMGVSGAGKSTIGKMLGKALSCDFLXADDFHSLSNRDKMRQGIALSDEDRMPWLEKIQESLRKRLLDVETVVLACSSLRKQYREILRGSDPDYKPGSYTSCKVTFVLLEGNAEVIAARLQKRASEEEHFMPLTLLQSQFDLLQADECEKIFKISVVLSPEVIVNTILEMVANSLNP

SEQ ID NO: 152 - protein, 191 aa, Arabidopsis lyrata
  gi|297836390|ref|XP_002886077.1| predicted protein [Arabidopsis lyrata subsp. lyrata].
MSANNDVAGKVIVIMGVSGAGKSTIGKLLGKALSCDFLDADDFHSLSNRDKMRQGIALSDEDRMPWLEKIQESLRKRLLDGETVVLACSSLRKQYREILRGSDPDYEQGSYTSCKVKFVLLEGNAEVIAARLQKRASEGEHFMPLTLLQSQFDLLQADECEKIFKISVILSPEVIVNTILEMLGNSLREGI

SEQ ID NO: 153 - protein, 148 aa, Arabidopsis lyrata
  Fed A [Arabidopsis lyrata subsp. lyrata].
MASTALSSAIVGTSFIRRSPAPISLRSLPSANTQSLFGLKSGTARGGRVTAMATYKVKFITPEGEQEVECDDDVYVLDAAEEAGIDLPYSCRAGSCSSCAGKVVSGSVDQSDQSFLDDEQIGQGFVLTCAAYPTSDVTIETHKEDDLV

SEQ ID NO: 154 - DNA, 1386 bp, Zea mays
  P-Zm.Nac-1:1:2.
gaggtgcataaggctggcaagacgacagttaggaacgcatgcgagcgaggttgacggacgcgataaggttagcgcatgcgtcgaacgcgggctggcgagggtggaaggcatgataaggctattgggtagcgcaaaatgtgtagacagcgggcgagtgaggatggcagtggtggcatgcatggacgcggttggagcatacgcgacaagaatggagcacgacgtagatttcgggaggccgtggttggagcgcccgcgggcgagatggcggccatggttagagcgcccgtggttacgggtgggttcatggcgagcggaggggttgcaagatttccagggcgctcgggtcggttgcaagctccacggtggaggcgtgacggagacgacgtggggagggaggtcgtggggaaattcggacgagcagaggcgtggcaggtgtggcatggggagggaggtcgcggggagggcgcagggaggtggcatggggagggaggctggggacgaagatgatgtgggcccagagggacgcgggacaaagaattgcgtatgataacgggttgattcgtagaattttaggcggtatttataaaaatgacgcaggacagccattggtactgatactttaatatagtagagaagagatataaattaggacgggtacaacaagaccacacgtactaacatttttttttgtcacaggctgctctaatacatatctctatgataagcgagctagggatgctagcgtgtccatttgattcctatataaatctccaattatagctgtagcaattaatttaataaacacccaacaatagatcaaatctcatagcaaatcataatcatgaatgctccaaaatcagctagctggctctcccttatcttcgtttttccttcttctcctgcaacgaaaagaaaaaaaaagaaaagaaaagaaaacggccgcttgtggtactaactcccaactacgcacctaccgcgcgcataactcttggccgcctgccctcatcacctccgcgtcgccgtcgactcatccttatcctccccatcacgctcaccccgcgcccgcaccgcgccatccgtactttcccggccgccccaccgctggccgccccgacgtgtcgcgccgccaccggaaggtcccgggccgtcgggcgggcagagcgcctgcagcggtggacccacgccacgctgacgcgggcgcgcgtccgtccaagaaacctgacgtaagcagtgacagaattggcgccgcctctcggcgtccacgtgtcgtggtcaacctgtcagagtggggctccgtgtgtgcgctaccgcaggggcccggcgcacgggccacacgtgtcgcggtcgaccgcggctataaatgcccggctccgcactcggaacaag

SEQ ID NO: 155 - DNA, 85 bp, Zea mays
  L-Zm.Nac-1:1:1.
tttcaagctctcctcccctcttcctaccattagcagtagccacagccagaacaccagcagacagcagcatcagcagggaggaaca

SEQ ID NO: 156 - DNA, 804 bp, Zea mays
  I-Zm.DnaK-1:1:1.
accgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgg

SEQ ID NO: 157 - DNA, 1197 bp, Bacillus subtilis
  Coding sequence of SEQ ID NO: 158
atggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagctatctgctatatcggggacgccaatgagtcggtgcaggaagaggcgggggcgcctgttgctgaagacaatatgccgcaagccgtccagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaagcaaagcctgtttcggagcagaaagcgcaggaaatcccggtgacaggcatgagaaaggtcatcgctgcccgaatgcaggaaagcctggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatccccatgtgcaccttggtatggctgtagccttggaaaatggcttagtggtgcctgtcatccgccatgctgaaaagctatcgctgattgaactggctcaatccatctcagaaaatgccaaaaaagcacgcgagggacgtgcgggaagcgaagaactgcaaggatctactttctccattacaaaccttggcgcgtttggagttgagcatttcacaccgatactaaatccgccggaaacaggcattctcggcatcggagcaagctatgacacaccggtgtatcaaggggaggagatcgtcagaagcacgatcctgccactcagcctgacatttgatcacagagcgtgtgacggcgcccctgccgctgcattcctgaaggcgatgaaaacatatttggaagaacccgcagcattaattttatag

SEQ ID NO: 158 - protein, 398 aa, Bacillus subtilis
  Aacetoin dehydrogenase E2 component (dihydrolipoamide acetyltransferase).
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 159 - DNA, 1377 bp, Pseudomonas fluorescens
  Coding sequence of SEQ ID NO: 160.
atgacggtacccccgcgtgccgttcagcttaacgaagcgaacgcgttccttaaggaacatcctgaggttctgtacgttgaccttctgattgcggatatgaatggtgtggtgcgcggcaagcgcatcgaacgcaccagcctccacaaggtttacgagaaaggcatcaacctgccggcctctctatttgctctggatatcaatggttcgacggtggaaagcaccggcctgggcctggacatcggcgacgccgaccgtatctgctatccaatccccgataccctgtgcaacgagccatggcagaagcgcccgaccgcgcaactgttgatgaccatgcacgaactcgaaggtgaccctttcttcgccgacccgcgcgaagtgctccgtcaagttgttgcaaagtttgacgagcttggcttgaccatctgcgccgcgttcgaactcgagttttacctgatcgaccaggaaaacgtgaacggccgccctcagccgccacgctcgccgatctccggcaaacgcccgcattcgactcaggtttacctgatcgacgacctcgacgaatacgtcgactgcctccaggacattctggaaggcgccaaagagcaaggtattccggccgacgccatcgtcaaggaaagtgccccggcgcagttcgaagtgaacctgcaccacgtcgccgacccgatcaaggcatgcgactacgcggtcctgctcaagcgtctgatcaagaacatcgcctacgaccatgaaatggacaccactttcatggccaagccgtacccgggccaggcaggcaacggtctgcacgtccacatttcggttctcgacaaagaaggcaaaaacatttttgccagcgaggatcccgagcagaacgccgcgctgcgtcacgcgatcggcggtgtgctcgagaccctgcccgcgcagatggctttcctctgcccgaacgtcaactcctaccgtcgtttcggcgcacagttctacgtgccgaactcgccgagctggggcctggacaaccgcaccgtggccctgcgcgtaccgaccggctccgccgacgcggtccgtctggaacaccgcgttgccggcgccgacgccaacccgtacctgctgatggcttcggtgctggcgggcgtgcaccacggtctgaccaacaagatcgagccaccggctccgaccgaaggcaacagctacgagcagaacgagcagagcctgccgaacaacttgcgcgatgccctgcgcgagctggacgacagcgaggtgatggccaagtacatcgatccgaaatacatcgatatcttcgtcgcctgcaaagagagcgaactggaggagttcgaacactccatctccgacctcgagtacaactggtacctgcacaccgtttag

SEQ ID NO: 160 - protein, 458 aa, Pseudomonas fluorescens
  L-glutamine synthetase.
MTVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 161 - DNA, 943 bp, Solanum tuberosum
  T-St.Pis4-1:4:1.
accctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcga

SEQ ID NO: 162 - protein, 396 aa, Bacillus subtilis
  dihydrolipoamide acetyltransferase.
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKTDDHSFLSQEPPVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEKPQH

SEQ ID NO: 163 - protein, 458 aa, Pseudomonas syringae
  glutamine synthetase.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHEIEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGSADAVRIEHRVAGADANPYLVMASVLAGVHHGLVNKIEPGAPVEGNSYEQHEQSLPNNLRDALRELDDNPVMAKYIDPKYIDIFVACKESELEEFEHSISDLEYNWYLHTV

SEQ ID NO: 164 - protein, 458 aa, Pseudomonas putida
  glutamate--putrescine ligase.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVSKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRLEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 165 - protein, 458 aa, Pseudomonas syringae
  glutamine synthetase.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGTADAVRIEHRVAGADANPYLVMASVLAGVHHGLVNKVEPGAPVEGNSYEQHEQSLPNNLRDALRELDDNPVMAKYIDPKYIDIFVACKESELEEFEHSISDLEYNWYLHTV

SEQ ID NO: 166 - protein, 458 aa, Pseudomonas fluorescens
  L-glutamine synthetase.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVAKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKEGKNIFASEDPEQNAALRHAIGGVLETLPAQMAFLCPNVNSYRRFGAQFYVPNSPSWGLDNRTVALRVPTGSADAVRLEHRVAGADANPYLLMASVLAGVHHGLTNKIEPPAPTEGNSYEQNEQSLPNNLRDALRELDDSEVMAKYIDPKYIDIFVACKESELEEFEHSISDLEYNWYLHTV

SEQ ID NO: 167 - protein, 458 aa, Pseudomonas putida
  glutamine synthetase, putative.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVTKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRIEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 168 - protein, 458 aa, Pseudomonas fluorescens
  glutamine synthetase.
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVTKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKDGKNIFASEDPEQNAALRHAIGGVLETLPAQMAFLCPNVNSYRRFGAQFYVPNSPSWGLDNRTVAIRVPTGSADAVRIEHRVAGADANPYLLMASVLAGVHHGLTNKIEPGAPTEGNSYEQNEQSLPNNLRDALRELDDSEVMAKYIDPKYIDIFVACKESELEEFEHSISDLEYNWYLHTV

SEQ ID NO: 169 - protein, 458 aa, Pseudomonas fluorescens
  putative glutamine synthetase.
MSVPPRAVQLNEANAFLKDHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVSKFDDLGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISILDKDGKNIFASEDPEQNAALRHAIGGVLETLPAQMAFLCPNVNSYRRFGAQFYVPNSPCWGLDNRTVAIRVPTGSSDAVRIEHRVAGADANPYLLMASVLAGVHHGLTNKIEPGAPVEGNSYEQNEQSLPNNLRDALRELDDSEVMAKYIDPKYIDIFVACKESELEEFEHSISDLEYNWYLHTV

SEQ ID NO: 170 - protein, 515 aa, Medicago sativa
MGTNEWHVERRDSIGTESPVAREVLETGTLSIVVLGASGDLAKKKTFPALFHLYKQELLPPDEVHIFGYARSKISDDELRNKLRSYLVPEKGASPKQLDDVSKFLQLVKYVSGPYDSEDGFRLLDKEISEHEYLKNSKEGSSRRLFYLALPPSVYPSVCKMIKTCCMNKSDLGGWTRVVVEKPFGRDLESAEELSTQIGELFEEPQIYRIDHYLGKELVQNMLVLRFANRFFLPLWNHNHIDNVQIVFREDFGTDGRGGYFDQYGIIRDIIPNHLLQVLCLIAMEKPVSLKPEHIRDEKVKVLESVLPIRDDEVVLGQYEGYTDDPTVPDDSNTPTFATTILRIHNERWEGVPFIVKAGKALNSRKAEIRVQFKDVPGDIFRSKKQGRNEFVIRLQPSEAIYMKLTVKQPGLEMSAVQSELDLSYGQRYQGITIPEAYERLILDTIRGDQQHFVRRDELKASWQIFTPLLHKIDRGELKPVPYNPGSRGPAEADELLEKAGYVQTPGYIWIPPTL

SEQ ID NO: 171 - protein, 495 aa, Petroselinum crispum
MTSDKWSIEKRAPLRNDSVLKEENVPEIGCLSIVVLGASGDLAKKKTFPALFNLYRQGFLQSHEVYIFGYARTKISDEELRDRIRGYLVPSKNTVEGHEEDLTNFLQLIKYVCGSYDTEEGYQLLDKEISEHEIYRNCTEGSSRRLFYLALPPSVYPPVCKMIRKCCMNKSDLGGWTRIVVEKPFGRDLESAEQLSNQIGELFEEPQIYRIDHYLGKELVQNLLVLRFANRFFMPLWNRDNIDNIQIVFREDFGTDGRGGYFDQYGIIRDIIQNHLLQVLCLVAMEKPVSLKPEHIRDEKVKVLQSVVPIKDEEVVLGQYDGYLEDPTVPDGSYTPTFATMVLRIHNERWEGVPFILKAGKALNSRKAEIRVQFKDVPGDIFKSKKQGRNEFVIRLQPSEAMYMKLTVKQPGLKMSTVQSEMDLSYGQRYQDVTIPEAYERLILDTIRGDQQHFVRRDELKAAWEIFTPLLHRIDKGEFKSLPYKPGSRGPEESG

SEQ ID NO: 172 - protein, 534 aa, Petroselinum crispum
MKSAVCDIVHKMSDKWCLEERAPVVEDSAGDPIVKDTQPPPPVSEDGCLSIVVLGASGDLAKKKTFPALFNLYRQGFLQSHEVYIFGYARTKISDDDLRDRIRGYLTPNKNTAEGHTEDVSKFLQLIKYVCGSYDAAEGFQCLDKEISEHEISRNSIEGSSRRLFYLALPPSVYPPVCKMIKTYCMNKSDLGGWTRIVVEKPFGRDLESAEHLSNQIGELFEEPQIYRIDHYLGKELVQNLLVLRFANRFFLPSWNRDNISSVQIVFREDFGTEGRGGYFDQYGIIRDIIQNHLLQVLCLVAMEKPISLKPEHIRDEKVKVLQSVAPLNDEEVVLGQYDGYLDDPTVPAGSNTPTFATMVLRIHNERWEGVPFVLKAGKALESRKAEIRIQFKEVPGDIFKCQKQGRNEFVIRLQPSEAMYMKLTVKKPGLEMSTAQSELDLSYGQRYQDVTIPEAYERLILDTIRGDQQHFVRRDELKAAWEIFTPLLHRIDKSELKSVSYKPGSRGPEEADELLKKVGYVQTHGYTWIPPTL

SEQ ID NO: 173 - protein, 516 aa, Mesembryanthemum crystallinum
MGSGEWHVEKRSSLKSELSKDIGESESSQECGSLSIIVLGASGDLAKKKTFPALFNLYRQGFLPPSEVHIFGYARSKMTDDDLRDRIRGHLIPRNVTAEISEDVLNFLHLIKYVSGSYDTEDGFHLLDDEISKYECQKNSQEHSKRLFYLALPPSVYPSVCRMIKLCCMNKSDLGWTRIVVEKPFGRDLESAEQLSAQIGELFDESQIYRIDHYLGKELVQNLLVMRFANRLFLPLWNRDNIANVQIVFREDFGTQGRGGYFDQYGIIRDIIQNHLLQVLCLVAMEKPVSIKPEHIRDEKVKVLQAVNLIKDEEVVLGQYEGYKDDPTVPEDSNTPTFATMVLRIHNERWEGVPFILKAGKALNSRKAEIRVQFKDVPGDIFKCNKQGRNEFVIRLQPSEALYMKLTVKQPGLEMSTIQSELDLSYGQRYQGVVIPEAYERLILDTIKGDQQHFVRRDELKAAWEIFTPLLHRIDKGEFKPISYKPGTRGPAEADELLAKAGYVQTHGYIWIPPTL

SEQ ID NO: 174 - protein, 516 aa, Arabidopsis thaliana; identical to SEQ ID NO: 142

SEQ ID NO: 175 - protein, 505 aa, Oryza sativa
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSSEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVFRVHNERWEGVPFILKAGKALSSRKAEVRVQFKDVPGDIFKCKRQGRNEFVIRLQPSEAMYMKLTVKKPGLEMATEQSELDLSYGMRYQNVKIPEACERLILDTIRGDQQHFVRRDELKAAWQIFTPLLHDIDEGKVKSIPYQPGSRGPKEADELSERVGYMQTHGYIWIPPTLA

SEQ ID NO: 176 - protein, 510 aa, Populus suaveolens
MGSGQWMVEKRSGLENDSFRNEHETASESGCLSIIVLGASGDLAKKKTFPALYHLYRQGFLDSNEVHIFGYARTKISDDELRDRIRGYLGKEAEVVSKFLQLIKYVSGSYDTEDGFQLLDKEVLQHEVSKNSAEGSSRRLFYLALPPSVYPSVCRMIRKCCMNKSDLGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYEGYRDDPTVPDQSNTPTFATVVLRIHNERWEGVPFILKAGKALNSSKAEIRVQFKDVPGDIFQCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGELKPKEYQPGSRGPVEADELLAKAGYVQTHGYIWIPPTL

SEQ ID NO: 177 - protein, 511 aa, Solanum tuberosum
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSGEGFTLLDKAISEHEFSKNSTEGSSRRLFYFALPPSVYPSVCRMIKSYCMNKSDLGGWTRIVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 178 - protein, 507 aa, Populus trichocarpa
MGSGQWKVEKRSSFRSDSFSKEYETVPETGCLSIIVLGASGDLAKKKTFPALYNLYRRGFLQSNEVYIFGYARTKISDDDLRNRIRGDILAKMLQSTLKMYQQIKYVSGSYDTEDGFRLLDKEISEHEVSKNSAEGSSRRLFYLALPPSVYPPVCRMIRKCCMNRADLGGWTRIVIEKPFGKDLESAEKLSAQIGELFEEPQLYRIDHYLGKELVQNLLVLRFANRFFLPLWNRDNIQIVFREDFGTEGRGGYFDEYGIIRDIIQNHLLQLCLVAMEKPVSLKPEHIRDEKVKVLQSVLPIKDEEVVLGQYEGYRDDPTVPDHSNTPTFATVVLRIHNERWEGVPFILKAGKALNSRKAEIRVQFKDVPGDIFKCQKQGRNEFVIRLQPSEAMYMKLTVKQPGLEMSTVQSELDLSYKQRYQGVAIPEAYERLILDTIRGDQQHFVRRDELKAAWEIFTPLLHRIDDGEMKPLQYQPGSRGPVEADELLAKAGYVQTHGYIWIPPTL

SEQ ID NO: 179 - protein, 511 aa, Populus trichocarpa
MGSGQWKVEKRSGLENDSFLKEHETAPESGCLSIIVLGASGDLAKKKTFPALYHLYRQGFLHPDEVHIFGYARTRISDDELRDRIRGDILAKKLKLYQSSCNQIKYVSGSYDTEDGFQLLDKEISQHEVSKNSAEGSSRRLFYLALPPSVYPTVCRMIRKCCMNKADHGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYDGYRDDPTVPDQSNTPTFATVVLRIHNERWEGVPFILKAGKALNSSKAEIRVQFKDVPGDIFKCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGEMKPKEYQPGSRGPVEADELLAKAGYVQTHGYIWIPPTL

SEQ ID NO: 180 - protein, 511 aa, Populus trichocarpa
MGSGQRKVEKRSGLENDSFLKEHETAPESGCLSIIVLGASGDLAKKKTFPALYHLYRQGFLHPDEVHIFGYARTRISDDELRDRIRGDILAKKLKLYQSSCNQIKYVSGSYDTEDGFQLLDKEISQHEVSKNSAEGSSRRLFYLALPPSVYPTVCRMIRKCCMNKADHGGWTRIVIEKPFGKDLESAENLSAHIGELFEEAQLFRIDHYLGKELVQNLLVLRFANRFFLPLWNRDNISNVQIVFRENFGTEGRGGYFDEYGIIRDIIQNHLLQILCLVAMEKPVSLKPEYIRDEKVKVLQSVLPIRDEDVVLGQYDGYRDDPTVPDQSNTPTFATVVLRIHNERWEGVPFILKAGKALNSSKAEIRVQFKDVPGDIFKCQKQGRNEFVIRLQPSEAMYMKLTVKQPGLEMSTVQSELDLSYMQRYQGVPIPEAYERLILDTIRGDQQHFVRRDELKAAWEIFTPLLHRIDNGEMKPKEYQPGSRGPVEADELLAKAGYVQTHGYIWIPPTL

SEQ ID NO: 181 - protein, 517 aa, Pisum sativum
MGTNEWHVERRSTSDTDSPLAPRRDVLETGTLSIVVLGASGDLAKKKTFPALFHLYKQDLLPSDEVHIFGYARSKISTDELRNKLQSYLIPKKDASPKDLHDVSDFLQLVKYISGGYDSEEGFRLLDIEISEHEYLKNSKEGSSRRLFYLALPPSVYPSVCKMIKTYCMNKSDLGGWTRVVVEKPFGRDLESAEELSNQIGELFEEPQIYRIDHYLGKELVQNMLVLRFANRFFLPLWNRDNIDNVQIVFREDFGTEGRGGYFDQYGIIRDIIQNHLLQVLCLITMEKPVSLKPEHIRDEKVKVLQSVLPIRDDEVVLGQYEGYKDDPTVPDESNTPTFATAILRIHNERWEGVPFIMKAGKALNSRKAEIRVQFKDVPGDIFRSKTQGRNEFVIRLQPSEAIYMKFTVKQPGLEMSAVQSELDLSYGQRYQGITIPEAYERLILDTIRGDQQHFVRRDELKASWEIFTPLLHKIDRGELKPIPYKPGSRGPAEADELLEKAGYVQTHGYIWIPPTL

SEQ ID NO: 182 - protein, 517 aa, Actinidia chinensis
MGSGAWTIEKRSTFRNESFSKEYVTVSETGCLSIIVLGASGDLAKKKTFPALFNLYRQGFLQSNEVHIFGYARTKISDDELRNRIRGYLIQGSGSSDKQLEEVSKFLQLIKYISGSYDSGEGFQLLDKEISGYEFSKNTVEGSSRRLFYLALPPSVYPSVCKMIKNNCMNKSDLGGWTRIVVEKPFGKDLGSAEQLSAQIGELFDEPQIYRIDHYLGKELVQNLLVLRFANRFFLPLWNRDNIANVQIVFREDFGTEGRGGYFDEYGIIRDIIQNHLLQVFCLVAMEKPVSLKPEHIRDEKVKVLQSVVPIKDEEVVLGQYKGYRDDPTVPDNSNTPTFATVVLRVHNERWEGVPFILKAGKALNSRKAEIRIQFKDVPGDIFKCQKQGRNEFVIRLQPLEAMYMKLTVKQPGLEMSTVQSELDLSYGQRYQGVTIPEAYERLILDTIRGDQQHFVRRDELKAAWEIFTPLLHRIDDGEVKPLTYQLGSRGPAEADQLLERAGYVQTHGYIWIPPTL

SEQ ID NO: 183 - protein, 507 aa, Zea mays; identical to SEQ ID NO: 147

SEQ ID NO: 184 - protein, 518 aa, Medicago truncatula
MATKDCWQCVQRSSIENDSPLSVDNNGPENGSLSIVVLGASGDLAKKKTFPALFNLYKQGFLLANEVCIFGYARTKISDEELRNRLRGYLVKEKDASPEKLETVSKFLHLIKYVSGSYDSENDFRLLDKEISKHESTTNTAEGSSRRLFYLALPPSVYPSVSKMIKTACMNKSDHGGWTRIVVEKPFGKDLESAEQLSTQIGGLFEEPQIYRIDHYLGKELVQNMLVLRFANRFFLPLWNRDNIANVQIVFKEDFGTDGRGGYFDQYGIIRDIIQNHLLQIFCLVAMEKPVSMRPEHIRDEKVKVLESVLPIKDEDVVLGQYEGYRDDPTVPDNSNTPTFASVILRVHNERWEGVPFILKAGKALGSRKADIRIQFKDVPGDIFKCQKQGRNEFVMRLRPSEAMYMKLTVKQPGLEMSTVQSELDLSYRQRYHDVTIPEAYERFILDTIRGDQQHFVRRDELKAFWEIFTPLLHRIDKGEFKSIPYKFGSRGPKQADELLEKAGYVQTHGYIWIPPTL

SEQ ID NO: 185 - protein, 517 aa, Zea mays
MSGGSSESSPLSGQNSLSSLSISKDNELSSESGCLSIVVLGASGDLAKKKTFPALFHLFQQGFLQSGEVHIFGYARSNLSDDGLRERIRGYLKGASDEHLSQFLQLVKYVSGSYDRVEGFELLNKAISEYETSKNNDSGSYRRLFYLALPPSVYPSVCKMIRSYCMSPSSHTGWTRVIVEKPFGKDLNTAEELSAELGQLFQEEQLYRIDHYLGKELVQNLLVLRFANRLFLPLWNRDNIANVQIVFKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTVKKPGLEMATEQSELDLSYGMRYNGVKIPEAYERLILDTIRGDQQHFVRRDELRAAWEIFTPLLHDIDGGKLRSVPYKPGTRGPQEADELSRRMGYVQTHGYVWVPPTLSKV

SEQ ID NO: 186 - protein, 517 aa, Zea mays
MSGGSSESSPLSGQNSLSSLSISKDNELSSESGCLSIVVLGASGDLAKKKTFPALFHLFQQGFLQSGEVHIFGYVRSNLSDDGLRERIRGYLKGASDEHLSQFLQLVKYVSGSYDRVEGFELLNKAISEYETSKNNDSGSYRRLFYLALPPSVYPSVCKMIRSYCMSPSSHTGWTRVIVEKPFGKDLNTAEELSAELGQLFQEEQLYRIDHYLGKELVQNLLVLRFANRLFLPLWNRDNIANVQIVFKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTVKKPGLEMATEQSELDLSYGMRYNGVKIPEAYERLILDTIRGDQQHFVRRDELRAAWEIFTPLLHDIDGGKLRSVPYKPGTRGPQEADELSRRMGYVQTHGYVWVPPTLSKV

SEQ ID NO: 187 - protein, 518 aa, Picea sitchensis
MGSGGVPSKVESESLSSSTISLPNTTESGCLSIVVLGASGDLAKKKTFPALFNLYRQGFLQSEDVYILGYARTKLSKEGLRDRIREHLKPAKADSTKDPTEVISDFLKLVSYVSGTYDTEEGFLKLNEEIAKYEESKNGAEGPSRRLFYLALPPSVYPIVCKMIRHHCMNQGGGWTRVIVEKPFGKDLTSAEDLSNQLGELFSEEQIYRIDHYLGKELVQNLLVVRFANRLFLPLWNRDNIDNIQIVFREDFGTEGRGGYFDEYGIIRDIIQNHLLQILCLISMEKPVSLYPEHIRDEKVKVLQSVEPIRADDVVLGQYEGYTEDPTVPKDSKTPTFATVVLRINNERWDGVPFILKAGKALNSRKAEIRVQFRDVPGDIFKCNKHGRNEFVIRLQPLEAMYMKLMVKKPGLEMSTTQSELDLSYQQRYQDIAIPEAYERLILDTIRGDQQHFVRRDELKVAWEIFTPLLNRIDNGEIKPCPYTPGSRGPKEADELAARVGYRQTPGYIWIPPSLQVD

SEQ ID NO: 188 - protein, 509 aa, Hordeum vulgare
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVGGSYDSGEGFEKLNKEISDYEMSNNSGSSRRLFYLALPPSVYPSVCKMIRTYCMSPTSRTGWTRVIVEKPFGRDLDSAEELSSQLGELFQEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHNIDAGKLKAVSYKPGSRGPKEADELSEKVGYMQTHGYIWIPPTLA

SEQ ID NO: 189 - protein, 515 aa, Arabidopsis thaliana [sequence omitted]

SEQ ID NO: 190 - protein, 516 aa, Arabidopsis thaliana; identical to SEQ ID NO: 76

SEQ ID NO: 191 - protein, 518 aa, Glycine max
MGTSEWHIERRSSFGTESPLAREAGNVPETGSLSIVVLGASGDLAKKKTFPALFHLYRQGFLPADEVHIFGYARTKISDDELRNRLRGYLVPNKGASPQLLEDVEKFLQLIKYVSGSYDSEDGFRLLDKEISEHEYLKKSVEGLSRRLFYLALPPSVYPSVCKMIKTCCMNKSDLGGWTRVVVEKPFGKDLESAEELSTEIGKLFEEPQIYRIDHYLGKELVQNLLVLRFANRFFLPLWNRDNIDNVQIVFREDFGTDGRGGYFDQYGIIRDIIQNHLLQVLCLVAMEKPVSLRPEHIRDEKVKVLESVLPIRDDEVVLGQYEGYKDDPTVPDKSNTPTFATVILRIHNERWEGVPFILKAGKALNSRKAEIRVQFKDVPGDIFKCKKQGRNEFVIRLQPLEAMYMKLTVKQPGLEMSTVQSELDLSYGQRYQGVTIPEAYERLILDTIKGDQQHFVRRDELKASWQIFTPLLHRIDEGEFKPLPYKPGSRGPAEADQLLEKAGYVQTHGYIWIPPTL

SEQ ID NO: 192 - protein, 516 aa, Cucumis hystrix
MESGSWHVEKRSSLRNDSFTGEDNVPETGCISIVVLGASGDLAKKKTFPALFHLFVQGFLQSNEVHIFGYARSKISDDDLRNRLRGYLVQGKTTDSEQLEEVSKFLQLIKYVSGSYDSAEGFQKLDKKISEHEISRNSKEGSSRRLFYFALPPSVYPSVCKMIKHYCMNKSDLGGWTRIVVEKPFGKDLESAEKLSSQIGELFDEPQIYRIDHYLGKELVQNLLVLRFANRFFLPLWNRDNIANVQIVFREDFGTDGRGGYFDEYGIIRDIIQNHLLQVLCLVAMEKPISLKPEHIRDEKVKVLQSVLPIKDEEVVLGQYEGYRDDFTVPDHSNTPTFATMVLRIHNERWEGVPFIMKAGKALSSRKAEIRVQFKDVPGDIFRCKKQGRNEFVIRLQPSEAMYMKLTVKKPGLEMSTVQSELDLSYRQRYQGVTIPEAYERLILDTIRGDQQHFVRRDELKAAWEIFTPLLHRIDNGELKSIPYKQGSRGPAEADELLEKAGYVQTHGYIWIPPTL

SEQ ID NO: 193 - protein, 514 aa, Lotus japonicus
MGTSEWHCEKRSSFINEDLESAPETGSLSIIVLGASGDLAKKKTFPALFNLYRQGFLPADEICIFGYARTKISDDELRNRLHGFLVKEKDASPEQLQDVSKFLHLIKYVSGSYDSENDFHLLDKKISEHESSTNSAEGSSRRLFYLALPPSIYPSVCKMIKTCCMNKSDLGGWTRVVVEKPFGKDLESAEQLSTQIGELFEEPQIYRIDHYLGKELVQNMLVLRFANRLFLPLWNRDNIANVQIVSKEDFGTEGRGGYFDQYGIIRDIIQNHLLQIFCLVAMEKPVSLNPEHIRDEKVKVLQSVLPLKDDDVVLGQYEGYRDDSTVPDHSNTPTFATVILRVHNERWEGVPFILKAGKALNSRKADIRVQFKDVPGDIFKCKKQGRNEFVIRLQPSEAMYMKLTVKQPGLEMSTVQSELDLSYRQRYQGVTIPEAYERLILDTIKGDQQHFVRRDELKASWEIFTPLLHSIDKGEFKSIPYQPGTRGPAEADELLLEKAGYVQTHGYIWIPPTL

SEQ ID NO: 194 - protein, 509 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRVYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIGGDQQHFVRRDELKAAWQIFTPLLHDIDAGKLKAVSYKPGSRGPKEADELSEKVGYMQTHGYIWIPPTLA

SEQ ID NO: 195 - protein, 513 aa, Triticum aestivum
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 196 - protein, 509 aa, Triticum aestivum
MAGTDSSASSRQSSFNSLAKDLELPLEKGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRGLDSAEELSSQLGELFEEDQLYRIDHYLGKELVQNLLVLRFANRLFLPLWNRDNVDNIQIVFREDFGTDGRGGYFDQYGIIRGIIQNHLLQVFCLVAMEKPVSLKPEHIRDEKVKVLQSVNPIKDEEVVLGQYQGYKEDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 197 - protein, 517 aa, Oryza sativa
MSGGSGDSSPSSGRASFSSLSGLKDLELSSESGCLSIVVLGASGDLAKKKTFPALFHLFQQGFLQSGEVHIFGYARSNISDDGLRERIRGYLKGASDEHISQFLQLIKYVSGSYNSGEGFASLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKCKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 198 - protein, 509 aa, Hordeum vulgare
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRTGWTRVIVEKPFGRDLDSAEELSSQLGELFQEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHNIDAGKLKAVSYKPGSRGPKEADELSEKVGYMQTHGYIWIPPTLA

SEQ ID NO: 199 - protein, 511 aa, Nicotiana benthamiana
MAASWCIEKRGSLRLDSFRENDNIPETGCLSIIVLGASGDLAKKKTFPALFNLYRQGFLQSNEVHIFGYARTKISDDDLRSRIRGYLSKGKEYQEEVSEFLQLIKYVSGSYDSGEGFSLLDKAIAEHEIAKNSMEGSSRRLFYFALPPSVYPSVCRMIKNYCMNKSDLGGWTRIVVEKPFGKDLASAEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSLKPEHIRDEKVKVLQSMLPIKDEEVVLGQYEGYKDDPTVPDNSNTPTFATMVLRIHNERWEGVPFIMKAGKALNSRKAEIRVQFKDVPGDIFRCNKQGRNEFVIRLQPSEAMYMKLTVKKPGLEMSTVQSELDLSYGQRYQGVVIPEAYERLILDTIRGDQQHFVRRDELKAAWEIFTPLLHRIDDGEVKPIPYKPGSRGPAEADELLQNVGYVQTHGYIWIPPTL

SEQ ID NO: 200 - protein, 510 aa, Nicotiana tabacum
MAASWCIEKRGSLRLDSFRENDNIPETGCLSIIVLGASGDLAKKKTFPALFNLYRQGFLQSNEVHIFGYARTKISDDDLRSRIRGYLSKGKEYEEVSEFLQLIKYVSGSYDSGEGFSLLDKAIAEHEFAKNSTEGSSRRLFYFALPPSVYPSVCRMIKNYCMNKSDLGGWTRIVVEKPFGKDLASAEQLSSQIGELFNEPQIYRIDHYLGKELVQNVLVLRFANRFFLPLWNRDNIDNIQIVFREDFGTEGRGGYFDEYGIIRDIIQNQLLQVLCLVAMEKPVSQKPEHVRDEKVKVLQSMLPIKDEEVVLEQYEGYKDDPTVPGNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYGQRYQGVVIPEAYERLILDTIRGDQQHFVRRDELKAAWEIFTPLLHRIDDGEIKPIPYKPGSRGPAEADELLQNVGYVQTHGYIWIPPTL

SEQ ID NO: 201 - protein, 511 aa, Nicotiana tabacum
MAASWCIEKRGSIRLDSFRDNDNIPETGCLSIIVLGASGDLAKKKTFPALFNLYRQGFLQSNEVHIFGYARTKISDDDLRGRIRGYLSQGKENEEEVSEFLQLIKYVSGSYDSGEGFSLLDKAIAEHEIAKNSTEGSSRRLFYFALPPSVYPSVCRMIKNYCMNKSDLGGWTRIVVEKPFGKDLASAEQLSSQIGELFDEPQIYRIDHYLGKELVQNLLVLRFANRFFLPLWNRDNIDNIQIVFREDFGTEGRCGYFDEYGIIRDIIQNQLLQVLCLVAMEKPVSQKPEHIRDEKVKVLQSMLPIKDEEVVLGQYEGYKDDPTVPDNSNTPTFATMVLRIHNERWEGVPFIMKAGKALNSRKAEIRVQFKDVPGDIFRCKKQGRNEFVIRLQPSEAMYMKLTVKKPGLEMSTVQSELDLSYRQRYQGVVIPEAYERLILDTIRGDQQHFVRRDELKAAWEIFTPLLHRIDDGEVKPIPYKPGSRGPAEADELLQNVGYVQTHGYICIPPTL

SEQ ID NO: 202 - protein, 511 aa, Solanum tuberosum
MAASWCIEKRGSIRNDSFRDNDNIPETGCLSIIVLGASGDLAKKKTFPALFNLYRQGFLQSNEVHIFGYARTKISDDDLRSRIRGYLSQGKENEGEVSEFLQLIKYVSGSYDSAEGFTSLDKAISEHEFSKNSTEGSSRRLFYFALPPSVYPSVCRMIKSYCMNKSDLGGWTRTVVEKPFGKDLASSEQLSSQIGELFDEPQIYRIDHYLGKELVQNLLVLRFANRFFLPLWNRDNIDNIQIVFREDFGTEGRGGYFDEYGIIRDIIQNHLLQVLCLVAMEKPVSQKPEHIRDEKVKVLQSMLPIEDEEVVLGQYEGYKDDPTVPNNSNTPTFATMVLRIHNERWEGVPFIMKAGKALNSRKAEIRVQFKDVPGDIFRCQKQGRNEFVIRLQPSEAMYMKLTVKKPGLEMSTVQSELDLSYGQRYQGVVIPEAYERLILDTIRGDQQHFVRRDELKAAWEIFTPLLHRIDNGEVKPIPYKPGSRGPAEADELLQNAGYVQTHGYIWIPPTL

SEQ ID NO: 203 - protein, 516 aa, Arabidopsis thaliana; identical to SEQ ID NO: 141

SEQ ID NO: 204 - protein, 515 aa, Arabidopsis thaliana
MGSGQWHVEKRSTFRNDSFVREYGIVPETGCLSIIVLGASGDLAKKKTFPALFNLYRQGFLNPDEVHIFGYARTKISDEELRDRIRGYLVDEKNAEQAEALSKFLQLIKYVSGPYDAEEGFQRLDKAISEHEISKNSTEGSSRRLFYLALPPSVYPSVCKMIKTCCMNKSDLGGWTRIVVEKPFGKDLESAEQLSSQIGELFDESQIYRIDHYLGKELVQNMLVLRFANRFFLPLWNRDNIENVQIVFREDFGTEGRGGYFDEYGIIRDIIQNHLLQVLCLVAMEKPISLKPEHIRDEKVKVLQSVVPISDDEVVLGQYEGYRDDDTVPNDSNTPTFATTILRIHNERWEGVPFILKAGKSLNSRKAEIRIQFKDVPGDIFRCQKQGRNEFVIRLQPSEAMYMKLTVKQPGLDMNTVQSELDLSYGQRYQGVAIPEAYERLILDTIKGDQQHFVRRDELKVAWEIFTPLLHRIDKGEVKSIPYKPGSRGPKEADQLLEKAGYLQTHGYIWIPPTL

SEQ ID NO: 205 - protein, 505 aa, Oryza sativa
MSGGSSPRSRRSSFNSLSRDLELPSEQGCLSVIVLGASGDLAKKKTFPALFHLFAQGFIQSGEVHIFGYARSNLSDDGLRERIRGYLKGASEEHLSDFLQHIKYVSGSYDSGEGFEKLNKEISEYEKSNKSESPRRLFYLALPPSVYPSVCKMIRTYCMNPSGWTRVIVEKPFGKDLDSAEELSAQLGELFDENQLYRIDHYLGKELVQNLLVLRFANRLFLPLWNRDNIDNIQIVFREDFGTDGRGGYFDQYGIIRDIIQNHLLQVFCLVAMEKPVSLKPEHIRDEKVKVLQSVNPIKHDEVVLGQYEGYKDDPTVPDDSNTPTFASVVLRVHNERWEGVPFILKAGKALSSRKAEVRVQFKDVPGDIFKCKRQGRNEFVIRLQPSEAMYMKLTVKKPGLEMATEQSELDLSYGMRYQNVKIPEAYERLILDTIRGDQQHFVRRDELKAAWQIFTPLLHDIDEGKVKSIPYQPGSRGPKEADELSERVGYMQTHGYIWIPPTLA

We claimed:

1. A plant comprising a recombinant DNA molecule comprising a polynucleotide encoding a polypeptide, wherein the nucleotide sequence of the polynucleotide is selected from the group consisting of:
   a) the nucleotide sequence set forth as SEQ ID NO: 21;
   b) a nucleotide sequence encoding a protein having the amino acid sequence of SEQ ID NO: 22 or 107;
   c) a nucleotide sequence with at least 90% identity to SEQ ID NO: 21; and
   a nucleotide sequence encoding a protein with at least 90% identity to SEQ ID NO: 22 or 107; wherein said plant has an increased yield as compared to a control plant.

2. The plant of claim 1, wherein said plant is a monocot plant or is a member of the family Poaceae, wheat plant, maize plant, sweet corn plant, rice plant, wild rice plant, barley plant, rye, millet plant, sorghum plant, sugar cane plant, turfgrass plant, bamboo plant, oat plant, brome-grass plant, Miscanthus plant, pampas grass plant, switchgrass (Panicum) plant, or teosinte plant, or is a member of the family Alliaceae, onion plant, leek plant, or garlic plant.

3. The plant of claim 1, wherein the recombinant DNA molecule further comprises a promoter that is operably linked to the polynucleotide encoding a polypeptide, wherein said promoter is selected from the group consisting of a constitutive, inducible, tissue specific, diurnally regulated, tissue enhanced, and cell specific promoter.

4. The plant of claim 1, wherein said plant is a progeny, a propagule, or a field crop.

5. The plant of claim 4, wherein said field crop is selected from the group consisting of corn, soybean, cotton, canola, rice, barley, oat, wheat, turf grass, alfalfa, sugar beet, sunflower, quinoa and sugar cane.

6. The plant of claim 4, wherein said propagule is selected from the group consisting of a cell, pollen, ovule, flower, embryo, leaf, root, stem, shoot, meristem, grain and seed.

7. A method for producing a plant comprising:
   introducing into a plant cell a recombinant DNA molecule comprising a polynucleotide encoding a polypeptide, wherein the nucleotide sequence of the polynucleotide is selected from the group consisting of:
   a) the nucleotide sequence set forth as SEQ ID NO: 21;
   b) a nucleotide sequence encoding a protein having the amino acid sequence of SEQ ID NO: 22 or 107;
   c) a nucleotide sequence with at least 90% identity to SEQ ID NO:21; and
   d) a nucleotide sequence encoding a protein with at least 90% identity to SEQ ID NO: 22 or 107;
   and growing a plant from said plant cell.

8. The method of claim 7, further comprising selecting a plant with increased yield as compared to a control plant.

9. A method for increasing yield in a plant comprising:
   crossing the plant of claim 1 with itself, a second plant from the same plant line, a wild type plant, or a second plant from a different line of plants to produce a seed;
   growing said seed to produce a plurality of progeny plants; and
   selecting a progeny plant with increased yield.

10. The plant of claim 1, wherein said plant is a dicot plant or is a member of the family Amaranthaceae, spinach plant, quinoa plant, a member of the family Anacardiaceae, mango plant, a member of the family Asteraceae, sunflower plant, endive plant, lettuce plant, artichoke plant, a member of the family Brassicaceae, *Arabidopsis thaliana* plant, rape plant, oilseed rape plant, broccoli plant, Brussels sprouts plant, cabbage plant, canola plant, cauliflower plant, kohlrabi plant, turnip plant, radish plant, a member of the family Bromeliaceae, pineapple plant, a member of the family Caricaceae, papaya plant, a member of the family Chenopodiaceae, beet plant, a member of the family Curcurbitaceae, melon plant, cantaloupe plant, squash plant, watermelon plant, honeydew plant, cucumber plant, pumpkin plant, a member of the family Dioscoreaceae, yam plant, a member of the family Ericaceae, blueberry plant, a member of the family Euphorbiaceae, cassava plant, a member of the family Fabaceae, alfalfa plant, clover plant, peanut plant, a member of the family Grossulariaceae, currant plant, a member of the family Juglandaceae, walnut plant, a member of the family Lamiaceae, mint plant, a member of the family Lauraceae, avocado plant, a member of the family Leguminosae, soybean plant, bean plant, pea plant, a member of the family Malvaceae, cotton plant, a member of the family Marantaceae, arrowroot plant, a member of the family Myrtaceae, guava plant, eucalyptus plant, a member of the family Rosaceae, peach plant, apple plant, cherry plant, plum plant, pear plant, prune plant, blackberry plant, raspberry plant, strawberry plant, a member of the family Rubiaceae, coffee plant, a member of the family Rutaceae, citrus plant, orange plant, lemon plant, grapefruit plant, tangerine plant, a member of the family Salicaceae, poplar plant, willow plant, a member of the family Solanaceae, potato plant, sweet potato plant, tomato plant, *Capsicum* plant, tobacco plant, tomatillo plant, eggplant plant, *Atropa belladonna* plant, *Datura stramonium* plant, a member of the family Vitaceae, grape plant, a member of the family Umbelliferae, carrot plant, or a member of the family Musaceae, banana plant.

11. The plant of claim 1, wherein said plant is a maize plant.

12. The plant of claim 1, wherein said plant is a wheat plant, maize plant, rice plant, barley plant, sorghum plant, soybean plant or an alfalfa plant.

13. The plant of claim 1, wherein said nucleotide sequence of the polynucleotide has at least 95% identity to SEQ ID NO: 21.

14. The plant of claim 1, wherein said nucleotide sequence encodes a protein with at least 95% identity to SEQ ID NO: 22 or 107.

15. The method of claim 7, wherein said nucleotide sequence of the polynucleotide has at least 95% identity to SEQ ID NO: 21.

16. The method of claim 7, wherein said nucleotide sequence encodes a protein with at least 95% identity to SEQ ID NO: 22 or 107.

17. The plant of claim 1, wherein said nucleotide sequence of the polynucleotide has at least 98% identity to SEQ ID NO:21.

18. The plant of claim 1, wherein said nucleotide sequence encodes a protein with at least 98% identity to SEQ ID NO: 22 or 107.

19. The plant of claim 1, wherein said nucleotide sequence of the polynucleotide has 100% identity to SEQ ID NO:21.

20. The plant of claim 1, wherein said nucleotide sequence encodes a protein having 100% identity to SEQ ID NO: 22 or 107.

* * * * *